United States Patent 9,353,359 (BACTERIAL ANTI-PHAGE DEFENSE SYSTEMS) - sequence listing, part 3

SEQ ID NO: 6501 - DNA, 984 bp, Salmonella enterica serovar Dublin CT 02021853
gtggagactaaaaccgttgccattaccatgggcgatccagcgggcattgggccggaaattattgttaaagcgctaagcgaagacggtctcaacggcgcgccgctggtggttattggatgcctcgcaacgttgaaacgtttacaggcgaagggcatcacgccgaacgtcgagttacgggccattgaacgggtcgccgaagcgcgttttgcgcccggcatcattcatgtgattgatgagccgctggcgcagccggaggcgctggaggccgggaaagttcaggcgcaggcgggggatttagcgtatcgctgcgtgaagcgcgccaccgagttagcgttacggggcgacgtacaggctatcgctaccgcgccgctgaataaagaggcgctgcacctggcggggcacaactatccgggccataccgagctgctcgcgaccctgacccatagccgcgattacgcgatggtactttacaccgataaactaaaagtgattcacgtttcaacgcatatcgcgctgcgtaaattccttgatacgttaagtaccgcgcgtgtcgaaacggtgattggcattgctgatactttcctcaagcgtgtgggttacgttaaaccgcgtatcgccgtggcaggcgtgaatcctcatgcgggcgagaatggcctgtttggcgatgaagagacgcgtatcctgacgccagccattaccgatgcccgcgcaaaaggtatggacgtttatgggccgtgcccgccggatactgtatttctccaggcttatgagggacagtatgatatggtggtggcgatgtatcatgaccaggggcatatcccgttgaaattgcttggcttttatgatggcgtgaatatcaccgcagggctgccgtttatccggacttctgccgatcatggcaccgcatttgatatcgcctggacgggaaaagcaaaatctgagagcatggccgtatcgatcaaactggcaatgcaactggcataa

SEQ ID NO: 6502 - DNA, 1011 bp, Methylobacterium nodulans ORS 2060
gtgagcgccgccgtaaaacccgtcatcggggtgacgatgggcgatgccgccggcatcggcccggagatcgtcgtccgagccctcgtcgagccggaggtccgcgaggcctgccacgcgatcgtcatcggcgacgccggcatcatgcgggacgccgtcgcgctgaccggcctgccgtgcgagatccgtgcggtctcctccgtcgcggaggcagaattccgcgacggcacgatcgacgtcctggaccttcgcaacatcgcccgctcagacttcgagcccggacgcatcagcgcggcttgcgggcgcgccttcgtcgagtacatccgccgcgccgcgcggatggccctctcgggcgagatcgacgccgtcgcctcggcgccgaccaacaaggaggcgatgcacgcggccggcgagatctacccaggtcagaccgagatcttcgccgaggagagccggtcgacggacccgttcacgatcctgaccggggggaagatgcgggtcttcctcgtctcctcgcacgtatcgctctctcaggcgatcgcactcgtgacccagccgcgcatcgaactcgtgatccgcaaggcggtggcctcgctgaaggagctgtggggcattgatgacccattgatcggcgtggccggcctgaacccacacgccggcgacggtggcctgttcggtcgcgaagagatcgagcacgtgattccggtgctcgagcgcctgcgcgccgaaggcatccgcatcgaaggccccggcccggcggacagcgtctacgaccgggcggaccgcggtgcctatgacggcgtgatcggcatgtatcacgatcagggcgtgatcccgctgaagcgctacggctacgtcacggtgatttccggcacgccgatcatccgcacgacagccggtcacggcacggcctacgatatcgcctggaagggcatcgggcgcgcgaacgtcatgcagcgcgcggtggtgctggcggccgagctggccgccagtcgtgcggcgcgggcgcgatga

SEQ ID NO: 6503 - DNA, 1035 bp, Pedobacter heparinus DSM 2366
atgaaaacgaataataaaaaacctattttaggtataacgatgggagatcccgcaagtattggccctgaagtagctgtaaaagcgctggctaatgctggtatatatgaaatctgtaagccactattggtgggtgatgcagagatctgtaaggacgcgatcagattttgcggactggatctggttgtcaacgctgtaaaggatgttaaagatgcaaaatttgagtttggcagtattgatgtatatgatcttgaatatgcaagtgccgatattgtgaccggacaaaattctgttgcagcaggtgctgccgctttcaatacagtagttaaagtgattgatctggcgatgaagggtttggtagatgctacggtaaccggaccgatcaataaagaatctattcatctggcagggcataaattttcagggcataccgagatttatgcacattatacagatacgaagaaatacgggatgttgctggtggaagatgacctgagggtaatccatgtgtctacacacgtttccttaagacaggcatgcgacctggtaaaaaaacaaagaatactggataccattgaactgattgtttctgcctgtcggcaattgggcatcagcaatcctaaaattggggttgccggattaaacccgcatgccagcgatggcggcctgtttggcgaggaagaacagctggaaatcattccggctattgaggaggcaagacgcagaggatatacggtagaaggcccggtgcccgccgatacgctatttcctaaagccataggtggcgtatatgatgggattgtagcgatgtaccatgatcagggccatatcccttttaaagtggttgggtttaactgggataagtccgccaggcaaatgaaaagtgttaggggagtaaacattaccttagggctgcctatcataagaacttcagtagatcatggtacagcaatggaaattgccggaaggggaatagccagcgccgacgcgatgaatttagcaatcgagtatgccgttaacatggtgcgtaccaaataa

SEQ ID NO: 6504 - DNA, 981 bp, Dickeya dadantii Ech703
gtgagtaagataattgcggtaacaatgggagacccggcaggtatcggcccggaaattatcatcaaatcgctggcggaaggcgaactttccggcgcgccggtggtggtggtgggatgcgtgcagacgctgcgccgcattctggcgctcggcgtcgtgccgcaggtggagctgaacgaaattgccaacccggcgcaggcgcgcttcgcccccggcgtcgtcaatgtcattgatgaacctctggcggatccggccgggcttgagccgggaagagtacaggcccaggcgggcgatttagcttaccgctgcgtgaaacgcgccaccgaactggcgatggcgggtgaagtacacgcgattgccactgcgccgctgaacaaggaagcgctgcattccgccgggcatctctatcccggtcatactgaattgctggcgaagctgaccaacagccgcgattatgccatggtgctgtataccgatcggctgaaggtgatccatgtgacgacacacatcgcattgcgcaaattcctggatacgctgaatcgcgagcgcgtggaaaccgtcatcggtatggcggataccttcctcaaacgtgtgggctatgacaaaccgcgtatcgctgtcgccggggtcaacccgcatgccggggaaaacggcctgttcggcgacgaggagatcaatatcgtgtcgccgtccatcgaggcgatgaaggccaaaggtctggatgtgtatggcccctgcccgccggataccgtatatctgcaggcgtatgaaggccagtacgatatggtggtggcgatgtatcacgatcagggccacattccgctgaaactgcttggtttctacgatggtgttaatattactgcgggtttgccgttcatccggacatcagcggatcacggtacggcgttcgacatcgcctggacgggcaaggcgaaggccgaaagtatggcggtttcgatcaaactggcgacccagctggcctga

SEQ ID NO: 6505 - DNA, 981 bp, Dickeya zeae Ech1591
gtgagtaaaattattgcggtaaccatgggcgacccggctggcatcggtccggagatcatcatcaaatcactggccgaaggggatctgtccggcgcgccggcggtggtggtgggctgcgtacagacgctgcgccgtattctggcgttaggcgttgtgccgcaggtggagctcaatgaaatcgaacgtcctgccgatgcacgtttcgcgcccggcgtcattaacgtgatcaacgaaccgctggacgacccgcagggcctgaagcaaggggtggtgcagccacaggccggcgatttggcgtatcgttgcgtaaaacgtgcgactgagctggcgatggccggcgaggtacatgcgattgccaccgcgccgctcaataaggaagcgctgcactccgccgggcatctttatccggggcacaccgagctgctggcgaaactgaccaacagccgtgactacgcgatggtgctgtacaccgacaaactgaaagtgattcacgtcactacccatattgcgctgcgcaaattcctggatacgctgaaccgcgagcgggtggaaaccgtaatagcgatggcggatacgttcctgaaacgcgtgggttatcaggctccgcgcattgcggtagccggggttaacccgcacgcaggcgaaaacggcttgttcggtgatgaagaaattaagattgtcggcccgtccatcgaggcgatgaaagccaaaggcatcgacgcttacggcccgtgcccgccggataccgtctacctgcaggcgtatgaggggcaatacgacatggtggtggcgatgtaccacgatcaggggcatattccgctcaagctgctgggcttttatgatggcgtgaatatcaccgccgggttgccgtttatccgcacctccgcggaccacggcaccgcgtttgatatcgcctggacaggtaaagcgaagtctgacagcatggcgatctccatcaaactggcgatgcaactggcctga

SEQ ID NO: 6506 - DNA, 981 bp, Pectobacterium carotovorum PC1
gtgagtaaaattattgcggtaacgatgggtgatccggcagggattggaccggaaattattatcaagtcgctggccgagggcgagctttccggcgcgtctgccgtggtggtgggctgcgtacagacgatgcaacgtattctggcgctgaatgttgtgccagccgtagagctgaaaatcattgataaacccgctgacgcggtcttcgcgccaggcgtcatcaacatcattgatgagccgctggaagatccgcaggcgctgaagccgggggtcgttcaggcacaggcgggtgatttggcttatcgctgcatcaagaaagcgactgcattggcgatggccggtgaggtccacgcgattgcgacggcaccgctgaataaagaagcgctgcactcggcggggcatatttatccgggtcacaccgagctgctggcgaagctgaccaacagccgcgactatgcgatggtgctgtataccgataaattgaaggtgatccatgtttcaacgcacatcgcgctgcgtaaattcctggatacgctgaaccgcgagcgcgtggaaacggtgatcgacatggcggatgtcttcctcaagcgcgtcggttttacccacccacgtatcgccgttgccggggttaacccgcatgcgggcgagaatggtctgtttggtgacgaagagatcaaaattgtgtcgccatcggttgaagccatgaaggccaaaggcattgatgtttatggcccgtgcccgccggataccgtctatttgcaggcgtatgaaggtcagtacgacatggtagtggcaatgtatcacgatcagggacacattccgctcaagctgctgggcttctatgatggggtgaacatcactgccggattgccgtttatccgcacctctgctgaccacggcacggcgtttgacattgcctggaccggtaaagcgaagtccgaaagcatggcgatctctatccagctcgcgatgcaactggcctga

SEQ ID NO: 6507 - DNA, 567 bp, Shewanella oneidensis
atggcaaatgaaacccgaggccgacgctctaaggtagatttactgccagccaatatccgcaaacgcttggatagcggcctgcgtgatggctcgattcagcagactgagttacttgaagaaattaacgcccttatcaaagcagctgggttgccgaaggataatcttctgtctcgcgcaggcattaaccgctatgccaccaagatggaggccgtgggtaaatccttaagggaaatgcgtgagatcacccaagtgtggacggcagaactgggcgataaacccacgggcgaagtgaccaaattcatccttgaaattggccgttcacagctcctaaaagcaatgttaaacgagtctgaaagcgatatggccgacgttggtctgattaaagatgccatgcttgcggtgcagcgtttggagtctgccgccatggccagccataagcgcgagaaagagatccgccaagcctttgccgccgaggccgcacatgctgctgagaaggtggccaagtccgcaggcttaaccagtgatgccgtagcaatgcttaaacgcgagatattggggattgcctaa

SEQ ID NO: 6508 - DNA, 558 bp, Methylobacillus flagellatus KT; identical to SEQ ID NO: 2549

SEQ ID NO: 6509 - DNA, 522 bp, Polaromonas JS666
atgacgcaacgcagcaaggtagtcaccctgccagaggccacccgcgccgagctggaccgccgcctgatcaccgagggctttcgcggctatgacgagctggagctatggctgcgggagctgggctacgagatcggcaaaagcagcatccaccgctacggcaccaagctggagcagcggctcgaccagctcaagcgcgccaccgaccaggccaaggccctggtggccgcagcgcccgacgatgcaggcgacatgagccaggccgtgctgcgcctgatgcaggaaaagattttctcggcgctgatggagatggaggttgaccccgacgagcagtcgctgggcggcctggccaaggcgctggccccgctggtgcgtgccaatatcgcgcagcagaagtttgccagcgaggtcaaggaaaaagcccgcagcgcggccgaggcggtggacaagctggcgcgcaagggcggcttgaccgacgacacggtggacgccatccgtcgccagattttggggattgcagcatga

SEQ ID NO: 6510 - DNA, 582 bp, Vibrio cholerae O395; identical to SEQ ID NO: 2551

SEQ ID NO: 6511 - DNA, 570 bp, Shewanella baltica OS185; identical to SEQ ID NO: 2552

SEQ ID NO: 6512 - DNA, 570 bp, Shewanella baltica OS195; identical to SEQ ID NO: 2554

SEQ ID NO: 6513 - DNA, 552 bp, Thioalkalivibrio HL EbGR7; identical to SEQ ID NO: 2558

SEQ ID NO: 6514 - DNA, 585 bp, Agrobacterium vitis S4; identical to SEQ ID NO: 2559

SEQ ID NO: 6515 - DNA, 891 bp, Desulfovibrio desulfuricans G20
atgtctctgccccgcggccatgcccgtttaggaacaaccctgctgcgtctggccccagtactggtgccctgcggcgtgcttttcaccggcggctttgcgcttactctggcgcagtcgctggggtatgcgctgccggtacccgcgccggaggggcagccgtctgccgcggcataccgtatgctgctgcagccctattaccttgcttcatttctgctttccgtaaaagtggcctttctgtccgcagccgtatccgtggtatgcggtgccctgctggcggtgggggtgtggcgtctgccgtaccgtctgcagcaggccgccgtggtgtacaaagtgccgctgattctgccgcatgtggctgtggcgttgctgtgccttgtgttctggtcgcgctcggggcttgtctcctctctggcatggcagacgggccttgtgacgcagcaggccgattttcccgccgtgctgtatggcggcagcgggctgggtatggtgctggcctatgtctataaagaaattccctttgtcatgctcatgtcctatgccgcgctgaaacggctggaccatcggctgctggacaccgccgccatgctgggggcggggcggcttctgacatggcgttccgtcattttgccgcatctggcgcctacgctgcatcccgtatttatcattttgtttctttttgccttcggcgggttcgaggtgccgtacctgctgggcgaaagcaatcccggcatgctgagtgtggagatttacaacctgtattttcagcgggggctggcccgccgcccggaagccatggcggtgctgacggtcatgtttctgttctctcttgtttttgtggcgctgtacagccggctggtgcgtcgtttcggactgggggaacgcaaactgtga

SEQ ID NO: 6516 - DNA, 867 bp, Yersinia pseudotuberculosis IP 31758
atgaaaagctggcgcaacgatctgcttgcctggtcgctgatgttgagtggcctgggcaccattctgttattgatgggttccaccttttatgtcgtggtggtgcagagcctcggttacttcaaccttgaaggggaaagccatttttcgctggagttctggcgtgacatgttgcaggacgaggtgctgcatagcgccctattctactcggtaaaagtttcggtgctgggcgcgtttggttcggtaatcttcgcgtatccgctggcgttatggctgcgcaagccgctgatcgctaaagaaggtattatcgccgtgctacgcgcaccgatgtttattcccggtatggtagccgcatttttgttcgtcaatatcatcgcctaccacggtgtgattaacgagttgttaatggcactgggggttatcaacgaaccgctgcgaatgcaaaacgatgacttcggttggggcgttgttattctgcaagtctggaagaacctgccgtttgccctgattctggtgggcggtgcggttaatgccatccgcaacgatgtgctggacgccgccagcaacctcggggccaaccgcctacggagctttaccggtatcgtggtaccactcacattacctgccgtgcaggtgacgctcattctggtctttatcggtgcactcggcgatttcgcctttttctcggtcgccgggccgcgcaacacatattctctggcacgcctgatgcaagccaccgcgatggaatacggtgagtggaataacgctgccgtgatcgccgtcattattatgactaccgcggctatttttacgctgctgattgccactttaatcacaccgttcgccacccgtaaaggagacgtcaaatga

SEQ ID NO: 6517 - DNA, 867 bp, Yersinia pestis Angola
atgaaaagctggcgcaacgacctgcttgcctggtcgctgatgttgagtggcctgggcaccattctgttattgatgggttccaccttttatgtcgtggtggtgcagagcctcggttacttcaaccttgaaggggaaagccatttttcgctggagttctggcgtaacatgttgcaggacgaggtgctgcatagcgccctattctactcggtaaaagtttcggtgctgggcgcgtttggttcggtaatcttcgcgtatccgctggcgttatggctgcgcaagccgctgatcgctaaagaaggtattatcgccgtgctacgcgcaccgatgtttattcccggtatggtagccgcatttttgttcgtcaatatcatcgcctaccacggtgtgattaacgagttgttaatggcactgggggttatcaacgaaccgctgcgaatgcaaaacgatgacttcggttggggcgttgttattctgcaagtctggaagaacctgccgtttgccctgattctggtgggcggtgcggtcaatgccatccgcaacgatgtgctggacgccgccagcaacctcggggccaaccgcctacggagctttaccggtatcgtggtaccactcacattacctgccgtgcaggtgacgctcattctggtctttatcggtgcactgggcgatttcgcctttttctcggtcgccgggccgcgcaacacatattctctggcacgcctgatgcaagccaccgctatggaatacggtgagtggaataacgctgccgtgatcgccgtcattattatgaccaccgcggctatttttacgctgctgattgccactttaatcacaccgttcgccacccgtaaaggagacgtcaaatga

SEQ ID NO: 6518 - DNA, 867 bp, Yersinia pseudotuberculosis YPIII
atgaaaagctggcgcaacgacctgcttgcctggtcgctgatgttgagtggcctgggcaccattctgttattgatgggttccaccttttatgtcgtggtggtgcagagcctcggttacttcaaccttgaaggggaaagccatttttcgctggagttctggcgtaacatgttgcaggacgaggtgctgcatagcgccctattctactcggtaaaagtttcggtgctgggcgcgtttggttcggtaatcttcgcgtatccgctggcgttatggctgcgcaagccgctgatcgctaaagaaggtattatcgccgtgctacgcgcaccgatgtttattcccggtatggtagccgcatttttgttcgtcaatatcatcgcctaccacggtgtgattaacgagttgttaatggcactgggggttatcaacgaaccgctgcgaatgcaaaacgatgacttcggttggggcgttgttattctgcaagtctggaagaacctgccgtttgccctgattctggtgggcggtgcggtcaatgccatccgcaacgatgtgctggacgccgccagcaacctcggggccaaccgcctacggagctttaccggtatcgtggtaccactcacattacctgccgtgcaggtgacgctcattctggtctttatcggtgcactgggcgatttcgcctttttctcggtcgccgggccgcgcaacacatattctctggcacgtctgatgcaagccaccgctatggaatacggtgagtggaataacgctgccgtgatcgccgtcattattatgaccaccgcggctatttttacgctgctgattgccactttaatcacaccgttcgtcacccgtaaaggagacgtcaaatga

SEQ ID NO: 6519 - DNA, 912 bp, Desulfovibrio vulgaris  Miyazaki F
atggccggtggcgcaaccggctgggtaactggctggcgcatggccgcgctgtgtccgttgctggtgctgctggtcccctttctggcgggagtggggctgacggcggcccagtcgctggggtggctgctgccgatccagtacctgccggaacagggtgcgcaggggttgtacgcgccggacgtcctgacgggttggcggcaactggcgcagccgcacatggcgggctcgctgctgctgggggtgcgcgtggccggggtgtcggccctgctttccgtgtccgggggtgcgctgctggcctacggggtgtggcggctgcccgcccgcatgcaactggcggctctggtgttccgggtgccgctggtgctgccgcacatcgtggtggcctttctcgccatcgttttctggagccgttccgggctggtgtccgccgcgctgcatcaggccgggatcatcagcgggcaggcacagtttccggccctgctctggggcggcgacggcatgggcatggtgctggcctacacctacaaggaactgcccttcgtcatgctgctggccgtggcctcgctgcggcggctggacccccgcctgatcgagacggcccgcatgctgggcgccgggcggtgggccgtgctgcgcgacgtggtggtgccgcaccttgccccggtgctgcatgcctcgttcctcatcctgttcctgtatgccttcggcgcggtggaaattcccctgctgctgggcgaatccaccccggccatgcccggggtggcggcgtacgacctgtatttcctgcgctcgctggaggaccgccccgtggccgccgccctgctgaccctgttgctgctgtgctgtgccgggttcgtggctgcctacgtgcgtctggtggccgggctgcgcggacgggagcggcaactgtga

SEQ ID NO: 6520 - DNA, 855 bp, Agrobacterium vitis S4
atgccatcgctgcttcgccgccgctcgatccagctcctgctcttgctcctgccgggggtcggctatctgctgttcttcttcggcctgccgctgctgtcggcgctggtcggcagcttccggcttgaagatggcagctttacgctgagctggtatcagcggatcttcacccggccctccatgctgcgcggcctatccacctcaatctattacggtgtcatgccggttctggtgtcgctggcgctctccgtgccgctggcgcttctgctgcgcaaaagttttatcgggcgcaagctgttcagcgggctttacaagctgccgatggccgttccgagcattatcgtcggtctgatgatcatcgtcgtcttcgagcgcggtggctttttcgaccgcctgctggccccactcggctttaccctgccgaaactggtccgcgacgacctgggtgctggcgtcatcatcgccaattcctggaagcagatcccgttcatgacgctgatcatcaccagcgcctttgccgccattcccgaggatatccgctttgccgcccgcacgcttggcgcatcccggcttcggacatttttggctgtggacgtgccgcttgccatgccgggcattaccgccgccattctcctgaccttcatcggctcgatgggctcctatgccatacccgatattgtcggcccaccaacggcgcgcccactctctgtcctgatggtgcaggagttcaaacagggacggttcgagcaggtctatgcgatgggcatggtgctcagcctgttcgctgtcatcgttctcctgacctattatgccctgaccagccggatcggtgctggcaatgcgcgagggaatgcgtga

SEQ ID NO: 6521 - DNA, 861 bp, Dickeya dadantii Ech703
atgaagacaacgctgacggcctacctgctgctgttgccgggggtgggcgccatcgtgctgtttatgatcgccgtcttggggatggcggtgtcgcaatcggtgggttttttcaactttgccggggaaagcgggttctcgctgcggttctggcaaaccatgttggcagatgaacagctctggcggtcttttttctactcagcgcggatagcgacgctgagcgcgttgttatcggtcgcggtggcgtatccgttggccatctggctgcgtaagccgtttcccggttccgacctgctgcaggcgttgctcaaggcgcctctgttggtacacggcctgacggccgcttttctcttcgtcaatttcatcgcgtatcaggggtttctgaatctggcgctggtgcgtctggggatagggtcgcgccccgtgcgcctgcagaacgacccttatggcatcggcgtcgtgatactccaggtttggaaacagatgccgttcgcgctgctgctaatgagcggtgccgtgcgggcggtgggcgatacgttgctggaggccgcgcgtaatctgggcgccggaacctgggcgcgctttcatcgtgtggtgctgccattgacgttgcggtcgctacagactgcgctggtgctgattttcatcggcgccgccggggatttttcgttccagtccgtcgcaggccccgtcagtgtcaactccatggcgcagtttatgttgcgcgtgcagcaaagcggcgcggagggatggaatcaggcggcagtggtggcggtgatgttgatggcgttatcgctgttgggcgccggcgtactggccgcgtgtgccggcgtattggtacggcgtagcgggaggggaagatga

SEQ ID NO: 6522 - DNA, 855 bp, Dickeya zeae Ech1591
atgagggcgtcattgatggcgtatctgttgctgttgccgggggtgggcgtgatcgtgctggcgatgggggccgtcgtagggatggcgttctctcagtcgctgggttttttcaattttgccggagacagtgaattctcgctgcgtttttggcaaaccatgctggctgacgagcagctctggcgctcttttttctattcggcgcgtattgcgctgctcagtgcggtgctgtcggtcgtattggcttatcctctggccatctggctacgcaacccctttcctggtgcggtgaccctgcgtgccgtgttgaaagcgccgttgctggtgccggggctgacggcggcatttctgttcgtcaatttcatctcctatcaagggtttctcaacctggcgatgctacggttggggctaacggaacggccgattcgcctgcaaaacgatgccaacggcattggcgtgattgtgcttcaggtgtggaaacagatgccgtttgcgttgttgctgctgagcggctcggtgcaggccatcggcgataccctgctggatgccgcccgcaatctgggggccggcatgtgggttcgtttccgccgtattgtgttgccgctgacgttgcgggcgttgcagaccgccatgatgctgattttcattggtgcggcgggtgatttttcctttcagtcggtagccggcccggtcaacctaaattcgatgtcgcaactgatgctgcgcgtacagcaggcgggaacggaaggctggaatcaggcggcggtggtggcggtaatgctgatgctgttgtcgctggcgggagccgggttattggccctcgctacgggtgcggccgtacgtggcataaggggataa

SEQ ID NO: 6523 - DNA, 864 bp, Desulfohalobium retbaense DSM 5692
atgaccttgcgtcagatactccgcctcgccccgctcctcgctccgttcgggatccttttggctggcggcgtgggattgacagtggcccaatccctgggagtccttctcccggtgcctgtcccgggagggccactggaaggataccgggccgtgctcagtgcgcccggattctgggagacctgtctgttttccctcggcgtggccctggcctccgccctgctgagcgtcgccaccggtacctggcttggctacgccctatggcgacttccgccgcaaatgcggcggctcgggatcgtctacaaactccaactcatcctgccccatctgagcgtggcctttgtcgtccttcttttttggagcccgaccgggattctggcctctgtcctgtatcagctcggcctgctggaagccccggaccaatttccgaatatcctctactccggatacggtctggggatgatcctggcctacacctgcaagggggtgccctttgtcatgcttctggtgctggcgctcctggcccgttttgaccgccgccagctggcgaccgcacgcatgcttggggccgggtggtggcaaaccgcacgctatgtcctttatccccatttgcgcccggcaacgcacacatcgtttatcatcctctttttgtacagcttcggcgctttcgacatcccgtttatcctcggagaaagccgtccgggcatgctcagcatcgccgtgttcaaccgctacttcaaatccccgctcgacaaacggcccgaagcaatggccatgctggtcatcatgtttctctttgcggccacgtttatcgttctctacggacggatcgtgcgccacatcgacaacgcggcgcggaaattataa

SEQ ID NO: 6524 - DNA, 699 bp, Enterobacter sp. 638
gtggcagtgaacagttttaacaagggggcggtttcgccccttttgtctgtctggcgctcaacgttggcgctggcaggcgtgctgttgctttcggcctgcagccatgattccgctctgccgcccttcaccgcgagtggatacgcggccgatcagggtgcggtgcgaatctggcgtaaagacgtcaatggtgaagtccatctcctttctgcattcagtccgtggcacaagggcaatacctctacagcggaataccgctggcaggatgatgcgctgtcgctgattgaactcaatatctacagtaaaacgcctgaacacattcgtgtccggtttgatggtcgcggcgagctgagctttatgcagcgcgaagttgacggccaaaagcagcagctctcaagcgatcaaatcgctttataccgctatcgcgccgaacaaatccgccagaccagcgatgcgctgcgtcagggacgcgttgtgctgcgccaggggcgctggcatgccgatggcacggtgaccacctgtgaaagtcaaacgatcaaacctgatttggacgcgtgggcaagggagcgtatcgaaagacgccaacgtcattcgtcaatggaagtgagtgtggcctggcttgaagcatctgaaggttcgcagctgttgctggtggcaaatgaagatttttgtacctggcagccgacagaaaaacacttctga

SEQ ID NO: 6525 - DNA, 702 bp, Yersinia pseudotuberculosis IP 31758
gtgtcagtaaaaataataagcaggggggggataaaaccccttttgtttatgcggcgggtgctgataaccttcggattaaccttgggtctcagcgcctgtagcagcctgtcagatccccctcaattcagtgccagcgggtatatcgccgatagcggtgttgttcgtttatggcgtcaggataatgcgcagcagcaaccccaggtgttgatgagcgtttacagtccctacttcgggggcaatacccgagtgaccttctacgagtaccagaatggcattttacgggaaatccgtcgcaatgatttaggcgctaccccacagagtgtccagttgcgtttcgatgagcaagggcaggttagctttatgcaacgccagctcgcatcgcgtcgtgagtcgctctctgctgatgatatagcggtttatcagttggaagctaaacgcattttggaactcagtcgtgtgctacgtgcgggtgacgtaaggttaattcaggggcgttggcaggatggcatgcttactacctgtgcaggtaaaacgttgcgtctgaatctggatgataattcgcaggcatggctgacaacgcggggtgagaagaacacgcagcctcttggtgtcgcatggctggattcatctgaagggcaacaacttctgctggtcgcgaatcaggacttctgccgttgggaacctcaggcaggcagcctgtaa

SEQ ID NO: 6526 - DNA, 639 bp, Serratia proteamaculans 568
atggtcatcggcattgccgctggcctgagcgcctgcagcagtcattcagatcttccttcctttagtgccagcggttatgtggccgaccagggcgttatgcgcctgtggcgtaaagatgacgagcggcaccgcccgctggtgttgatgagcgtctacagtccctatcgtggtccgggcacagttaccacgctgtacgaatatcaagacggcaagctgcgccaaatcaaacgcactgacgccgatggcgatcaagactccattcaattgcgctttgccgatgacggcggagtaagctttatgcagcgccaactggccacgcggcgtgaacaactgaccgccgatgaaatcgcgctgtatcaatatcaggcacgacgcgtgctggaactgagcaatgcgctgcgcgccggtaaggtgaagctgctgcaggggcgttggcagcagggagtagtacaaacctgtgatggtcaaacgttgaagccggatctggatagcagtgccgaagcctggatcgcgcgacgtgcccgtaatagcagccagccggtgaatatagcctggttggatgcgccggaagggcgtgaactgctgctggtagcgaacgacgatttttgccgctgggaaccgaaagaagaccagctataa

SEQ ID NO: 6527 - DNA, 660 bp, Yersinia pestis Angola
ttgtttatgcagcgggtgctgataaccttcggattaaccttgggtctcagcgcctgtagcagcctgtcagatccccctcaattcagtgccagcgggtatatcgccgatagcggtgttgttcgtttatggcgtcaggataatgcgcagcagcaaccccaggtgttgatgagcgtttacagtccctacttcgggggcaatacccgagtgaccttctacgagtaccagaatggcattttacgggaaatccgtcgcaatgatttaggcgctaccccacagagtgtccagttgcgtttcgatgagcaagggcaggttagctttatgcaacgccagctcgcatcgcgtcgtgagtcgctctctgctgatgatatagcggtttatcagttggaagctaaacgcattttggaactcagtcgtgtgctacgtgcgggtgacgtaaggttaattcaggggcgttggcaggatggcatgcttactacctgtgcaggtaaaacgttgcgtctgaatctggatgataattcgcaggcatggctgacaacgcggggtgagaagaacacgcagcctcttggtgtcgcatggctggattcatctgaagggcaacaacttctgctggtcgcgaatcaggacttctgccgttgggaacctcaggcaggcagcctgtaa

SEQ ID NO: 6528 - DNA, 654 bp, Yersinia pseudotuberculosis YPIII
atgcggcgggtgctgataaccttcggattaaccttgggtctcagcgcctgtagcagcctgtcagatccccctcaattcagtgccagcgggtatatcgccgatagcggtgttgttcgtttatggcgtcaggataatgcgcagcagcaaccccaggtgttgatgagcgtttacagtccctacttcgggggcaatacccgagtgaccttctacgagtaccagaatggcattttacgggaaatccgtcgcaatgatttaggcgctaccccacagagtgtccagttgcgtttcgatgagcaagggcaggttagctttatgcaacgccagctcgcatcgcgtcgtgagtcgctctctgctgatgatatagcggtttatcagttggaagctaaacgcattttggaactcagtcgtgtgctacgtgcgggtgacgtaaggttaattcaggggcgttggcaggatggcatgcttactacctgtgcaggtaaaacgttgcgtctgaatctggatgataattcgcaggcatggctgacaacgcggggtgagaagaacacgcagcctcttggtgtcgcatggctggattcatctgaagggcaacaacttctgctggtcgcgaatcaggacttctgccgttgggaacctcaggcaggcagcctgtaa

SEQ ID NO: 6529 - DNA, 633 bp, Dickeya dadantii Ech703
ttggtgatagcgctggcgaccgcctgtagcagccattctccgccgccggcgttgtatgcgggtggttatcttgctgatcgcggtgtggtgcggttatggcgcatggatgacgagcaacagcacacgacgaccctgatgacggtattcagtccgcttcaggggcaggatacccagattacccgttatcagttccagcagggcgtcctgcgggatgttcagcagcgtcatggagcatcagcgagtcaggatcaggtcaggctgcgttttgatcaggacggtgcggtaaattttatgcagcgtcaactgcccgatcggcgggaatcgttgtcggaagatgagatcgcgctgtatcagtttgatgcccggcgcatgctggaaatgagtgacgtcatgcgcgcagggaatgtgcgtttgctgcaaggcgtgtggcaggaaggtcgtgtcgtcgcttgcgacgggaaggtactgaaaccggcattggacggttcatcgttggcctggatccggcagcgtcagcagaatgcgcgagcgccggtcagcattgcctggctggtgtccaacgcgggtacgcaattgctgctggtggcgaatgccgatctttgtcgttgggagccgacagcggagacgctgtaa

SEQ ID NO: 6530 - DNA, 711 bp, Dickeya zeae Ech1591
atgccgatacaaggtttaagcagaggggcgatttcgccccttttgcttttcttcaggcggcatcttcggtttgtcgttcccgtgttggcgtggttactgagcgcctgtagctttcagccgccgacgcctgccgtgtacgccagcggttatctggccgaccgtggtgtggtgcgcttgtggcgtaaagacgacgcgcagcagcatctcaccacactggtgacggcattcagctcattgcaagggaaagaggttcacataacgcgttaccgtttcctgcaagggacgttgcgggaagtccagcagacgacttccgcgtcgtcacaggatgaggtcaggctgcgttttgatcaggacggaaccgtgagctatatgcagcggcagttgccggaccggcgggaatcgctgtcggaagacgagatagccttgtaccagtttgatgcacgacgtttactggcgctgagtgattctctgcgcgcaggtaaagtgtctctgatgcaggggcgttggaacgccgggcaggtgatgacgtgcagtgggcaaacggtgcgcccggatctggatcgctcttcactggcttggatcgcccagcagagcgaacgcgccgccggacagctcagcgtggcctggctggtgtcgccggaaggtacgcaattgttgcaggtagcagaggcggatttctgtcgctgggagccaaccgccgaaacgtggtga

SEQ ID NO: 6531 - DNA, 687 bp, Pectobacterium carotovorum PC1
atgtcggttaaaagtttaagcagaggggcgttttcgccccttttgcttttacgacgctggtgtggcgtaggcctcatgcttactgctgtggtggcctgtagtagccgcaccgcaccgccggaatttttcgccagcggttacgttgccgatcgcggtatcgtgcgtttgtggcgtaaagacgatgcgcagaatacgacggcgttgaccaccgtgttcaacccgcttcagggcaatgcgctggtggtgactcgctatacgttccagcaggacaagctacgcgagatacagcgtaatcagcttggaacgcaaaaagaagatatgcgtttgcgctttgcagaagatggaaccgtcagctttatgcagcggcaacttgccgaaagacgtgaatcggtttctgatgatgatgttgcgctctaccagtttgatgctaagcgcatgctggagttgagcgatgtcctgcgtgcaggcaaggtgatcttaaaacaagggaaatggctggaaggccaggtgcagtcttgcgacggcacggcagttcgccctgattttgacaatgattcgcgtgaatggatcgcggagcaaaaaatgcatgcaacgcgtccgctaaatgtcgcatggctggaagcgccggaaggaacacagttattgctggtggtggaggatgatgtctgccagtggcagcctaaatag

SEQ ID NO: 6532 - DNA, 777 bp, Colwellia psychrerythraea 34H
atgagtaaagtattacaatgttgtcagctttctaagtcatatatacaaggtgacatcgaaactaaggtcttaaatgacttagaactaagtgttgataaaggagagttacttgcggtagttgggagctctggctgcggaaaaagtacctttttacatcttgctggtgcattagactcgccaagttcaggcaaggtgcttattaataatattgatatccatcagttgtctgataaagaaagagccaaatttagaaatgaacatattggctttatttatcaatttcatcacttgatgatggagtttaatgctcaagaaaatgtagcgatgccattaatgatccgaggtgaaaaaccaaaggatgcattgttagcagctaaagaaatgctcgaccaagtgggtttgtctcaccgaattgattaccgaccttcacaattgtcaggcggcgagcgtcagcgtgtagcaatagctcgtgcattggtgactaagccatctttagtgttagctgatgagcctaccggtaacttagatagcgatacagcggaacaaatttatcaattgattcgtagcttaaataaaacagcccagacaagttttgttatcgtcactcatgatctggtcttagcgaatcgtatggataggcaagtaaagttagttcaagggcaattaagaccactttcggataacagtgagcaagcattacctcctacttcaagtatcaccgatcctgcgaataacattaaagataatgaacctcaggcaaatgaacgtcatgtttaa

SEQ ID NO: 6533 - DNA, 702 bp, Shewanella denitrificans OS217
atgaaaccagcgtcgacccgcttattagccattaatgccgtgagtaaagtatttcatgatggtgcctgtgaaactcaggtgctccatgaggtgaatttaacggtgcatcgcggtgagcagcttgccatagtgggcagttcaggttcgggtaagagtaccttactgcatattatgggcaccttagaaagcccaacctctggtactgtgctattagaaggtgaaaatttacaccagctgtcatccaagcgccaagcgcaaattcgtaatcaagatttaggctttatttatcagtttcatcacctattgcctgagtttagcgccttagaaaatgtggctatgccggcgtttattcaaggtaagaataaagctcaaaccttggctgaagctaaagccctgttagaacgagtggggctaggtcacagattaacccatttaccctcgcaattatccggcggtgagcgccaacgggtggccatcgcaagggcacttatcaataaacctaaattggtattggccgatgaacctacggggaatttagacgctgtcagtggggaagctgtctacggacttattcgtgaacttgccgagcagcttggaaccgccttcgtggtggtgactcacgatgccaaccttgccgccagaatggacagacaagtgaacatgaaagacggcatcttatcccagagtgagacccatcgatga

SEQ ID NO: 6534 - DNA, 711 bp, Baumannia cicadellinicola Homalodisca coagulata
atgaataatacacctttattaaaatgttgccaactcagtaaaagctatcaagaaggagaattttcttcttgtgtgttactaaatgtgaatttaactatacacacaggagatatgatagcaattattggaccttctggctcaggaaaaagtacgctattgcatttactaggaggattagatacaccaacatctggtgatatcctttttgaaggaaagttacttaaaacattatcctcagcagcttgtgctaaattacgtaatcaacgattaggttttatatatcaatttcaccacctattatcagacttcactgctttagaaaatgttgcaatgccgagaatgataagaggagaaaaagcaaaggttgcacaaatagctgcacttaaaatgttaactatggtaggtttagaaaaacgtagtcatcagaaaccttctgaactatctggtggtgagcgtcaacgtgtagctgttgctcgagctctagtaaataatccatctcttgttctggccgatgaacctactggtaatctagataagcgtaatgcaaatatgatttttgaattaattagatcaattaacggcaaacatggtactgctttcattgttgttacacatgatttacgtctagctcaaagtttaccccgtcaatttgaaatgcaagaaggagtacttatgccatatggtagccctttattgagctccaatcaatga

SEQ ID NO: 6535 - DNA, 696 bp, Shewanella baltica OS155
atgcaagacgtgttactgcaagtgcagagtgtcagtaagagttaccatgatggcgccgtgaccacgcaagtgttgtctaatgttgatctgcaagtgtttaagggcgagcagttggcgattgtcggcagttcaggctcaggtaaaagtaccttgctgcacatcatggggactttggatgaaccaaccgcaggtaaagtcttgctgttaggcgaagatttatatcaagtgtccagtgcacgccaagcgcagatccgtaaccaagacttaggttttatctatcaattccatcatttattgccagaatttaccgcgctagaaaacgtcgctatgccagcgtttattcaaggtaaagatcgtaagctggcgctcgccgatgctaaagccttgttggagcgggtcgggttagggcatcgcatgacgcacattcctgccgagctatctggcggcgaacgtcaacgtgtggctatcgcaagggccttgattaataaacctaaattagtgctggccgatgaacctacgggtaacttagatgccaacagtggcgatgcggtttatgagttgatccgcgaactcgccgaacaactgggtacggcgtttgtggtggtgacccatgatcataaattggctgcccgtatggaccgtcaactgatgatgaagaacggcttcctgcaattagcggcggaaacccaagtatga

SEQ ID NO: 6536 - DNA, 702 bp, Enterobacter sp. 638
atgaataagatcctgttgcaatgcgacaacctgtccaaacgctatcaggaaggcaacgtgcagacggacgtgctgcatgaagtcagcttcagcgtgggcgaaggcgagatgatggcgattgttggcagctcaggctccggcaaaagtacgctgctgcacctgcttggcgggctggatacgccgacgtctggcgatgtgattttctccggtacgccgttaagttcgatgtcttcgacggcaaaagccgatctgcgtaaccgcgagctgggctttatctatcagttccaccatttgctaccggacttcaccgcgctggaaaacgtcgcgatgcctttgctgattggcaaaaagaaaccggctgaaattaacacgcgcgccagcgacatgctgaaagccgtggggcttgcacaccgcgggaatcaccgtccttccgagctatccggcggggaacgtcagcgcgttgccattgcacgcgcgctggtcaataacccgcgtctggtattggccgatgaaccgaccggtaacctggatgcgcgtaatgctgacagcattttccagctgcttggcgagctgaacgcgtcgcagggcaccgcatttctggtggtgacgcacgacctgcaactggcagggcggatgagtcgccagcttgagatgcgcgacggacgtctgacgacggaaatgaccctgatgggagccgagtaa

SEQ ID NO: 6537 - DNA, 696 bp, Shewanella putrefaciens CN-32
atgcaagacgtgttactgcaagtgcagaatgtcagtaagagttaccatgatggtgcggtgactacgcaagtattgtccaatgtggatctgcaggtctttaaaggcgaacagttagccattgtcggtagctctggttcgggtaagagtaccttattgcatattatgggaactttggatgagccaacggcgggtaaagttttgctgttaggcgaagatttatatcaagtatccagtgctcgccaagcgcagatccgcaatcaagatttaggctttatttatcaatttcaccatttattgcctgaatttaccgcgctagaaaatgtggcaatgcccgcatttattcaagggaaagatcgtaagcaagcgattgccgatgcaaaactgctacttgagcgggtggggctgggtcaccgcataacgcatattcccgccgaattatcgggcggcgaacgtcaacgagtagccattgcgcgggcgttaatcaatcaacctaaattggtgcttgccgatgaaccaacgggtaatcttgatgcaaatagtggtgatgccgtatatgagcttattcgcgagttagcaaatcaactcggtacagcctttgtggtggtaacccatgatcataaattagccgctcgcatggataggcaattgatgatgaaaaacggttatttgcaagtcgcggcggaaacccaagtatga

SEQ ID NO: 6538 - DNA, 696 bp, Shewanella baltica OS185
atgcaagacgtgttactgcaagtgcagagtgtcagtaagagttaccatgatggcgccgtgaccacgcaagtgttgtctaatgttgatctgcaagtgtttaagggcgagcagttggcgattgtcggcagttcaggctcaggtaaaagtaccttgctgcacatcatgggcacgttggatgaaccaaccgcaggtaaagtcttgctgttaggcgaagatttatatcaagtgtccagtgcacgccaagcgcagatccgtaaccaagacttaggttttatctatcaattccatcatttattgccagaatttaccgcgctagaaaacgtcgctatgccagcgtttattcaaggtaaagatcgtaagctggcgctcgccgatgctaaagccttgttggagcgggtcgggttagggcatcgcatgacgcacattcctgccgagctatctggcggcgaacgtcaacgtgtggctatcgcaagggccttgattaataaacctaaattagtgctggccgatgaacctacgggtaacttagatgccaacagtggcgatgcggtttatgagttgatccgcgaactcgccgaacaactgggtacggcgtttgtggtggtgacccatgatcataaattggccgcccgtatggatcgtcaactgatgatgaagaacggcttcctgcaattagcggcggaaacccaagtatga

SEQ ID NO: 6539 - DNA, 717 bp, Shewanella pealeana ATCC 700345
atgaatagcgagttaaaaatgaatcaagaattactgctacaagttagtcacgttagcaaacgttatcaagaaggctcagtcgatacccaggttttacatgacgttgagctacaagtctttaaaggcgagcaattagcgattgtgggtagctcaggctcgggcaagagtaccttactgcatattatggggaccctagatagcccaacgagtggtagcgtgaccatgttaggcgaagacttatataaactgtcgagccagcgtcaagcacagatccgcaacgagaaccttggctttatctatcagttccaccatctgttaccggaatttactgctcttgaaaatgtctcaatgccagcgcttattcaaggtaagagtcgaaagcaagtagaggccaaggccaaatccctgcttgagcgagtggggctagcccatcgactgagtcatactccggccgagatgtcgggcggtgaacgccaacgagtggcgatagcaagagccttgattaatgatcctaagttagttttggccgatgagccgacaggtaatttagatgcgaatagtggcgaagccgtttatgagctgatcaccgagcttgcggcgcagcttggcaccgcatttgttgtggtcacccatgatcaaagcttagctgccagaatggatagacagctgcatatgaaagatggccacctagtgcaagctgaggaactaactgcatga

SEQ ID NO: 6540 - DNA, 696 bp, Shewanella baltica OS195; identical to SEQ ID NO: 6538

SEQ ID NO: 6541 - DNA, 696 bp, Shewanella baltica OS223
atgcaagacgtgttactgcaagtgcagagtgtcagtaagagttaccatgatggcgccgtgaccacgcaagtgttgtctaatgttgatctgcaagtgtttaagggcgagcagttggcgattgtcggcagttcaggctcaggtaagagtaccttgctgcacatcatgggcacgttggatgaaccaaccgcaggtaaagtcttgctgttaggcgaagatttatatcaagtgtccagtgcgcgccaagcgcagatccgtaaccaagacttaggttttatctatcaattccatcatttattgcctgaatttaccgcgctagaaaacgtcgctatgccagcgtttattcaaggtaaagatcgtaagctggcgctcgccgatgctaaagccttgttggagcgggtcgggttagggcatcgcatgacgcacattcccgccgagttatcgggcggcgaacgtcagcgtgtggctatcgcaagggccttgattaataaacctaaattagtgctggccgatgaacctacgggcaacttagatgccaacagcggcgatgccgtttatgagttgatccgcgaactcgccgaacaactgggtacggcgtttgtggtggtgacccatgatcataaattggccgcccgtatggaccgacaactgatgatgaagaacggcttcctgcaattagcggcggaaacccaagtatga

SEQ ID NO: 6542 - DNA, 708 bp, Dickeya zeae Ech1591
atgagtaattcacctttattacagtgccgtcagctgtgtaaacgctaccaggaaggcaacctgtctaccgatgtgctgcgtgatgtgtcgttcgacatgcagaaaggcgaaatgatggcgattgtcggcagttccggctcaggtaaaagtaccttgttgcatttgctgggcgggctggatgcgccgacctccggcgaggtggtgtttcagggtaagacgttgaatcaactgtcggcggcggcgaaagctgcgctgcgtaaccgcgaactggggtttatctatcagtttcatcatctgctgccggatttcagcgcgctggaaaatgtggcgatgccgctgctgatcggcaatgtggcgccgaaagaggccaaagagcgggcgcagaccatgctggcggcggtcggtctggcgcagcgcagtcagcaccgctcctcggaactgtccggcggcgagcgccagcgtgtggcgattgcccgtgcgctggtgaataacccatcgctggtgctggcggacgaaccgaccggcaaccttgatcagcgtactaccgatgcgatttttgaactgttgggcgagctgaacgtccgtcaggggacggcatttttggtggtgacgcatgacctgcgtctggccggccgtctcggccggcagttggaaatgcgcgacggccagttgcagcaggagttaaccctgatgggggcgtcgcaatga

SEQ ID NO: 6543 - DNA, 708 bp, Pectobacterium carotovorum PC1
atgagtaatttatcgttattgcagtgcaacaacctgtccaagcgctatcaggacggcaagctgtcgactgacgtgttgcgcgacgtctcttttgagatgagcagcggggagatgatggcaatcgtcgggagttccggttcgggcaaaagtacgttgctgcatgtgctgggcgggttggatacgccgacgtcgggcgaggttatctttaaaggtcagtcgctgaatacactttcggcggcggcaaaggcagatttacgcaaccgcgagctgggttttatttatcaattccaccatctgttgccggatttcaccgcgctggaaaatgtggcgatgccgctgctgattggtaaagtgccaacctcgcaggcgcaggataaagcacgggaaatgctggcggctgtcgggctggaggcgcgcagccaccaccgttcgtcggagctgtccggcggtgagcggcagcgcgtcgctattgccagagcgttggttaacagcccgtcgctggtgctggcggacgagccgacgggtaacctcgaccagcgcacggcggataccattttcgaactgctgggagagctaaacgtccggcagggcactgcgtttttggtggtgacgcacgatctgcaactggctagccgactgaaccgccaactggaaatgcgtgatggtcaattgcagcaagagctgaccctgatgggagcgcggcaatga

SEQ ID NO: 6544 - DNA, 501 bp, Escherichia coli BL21 (DE3)
atgacagaatcaacatcccgtcgcccggcatatgctcgcctgttggatcgtgcggtacgcattctggcggtgcgcgatcacagtgagcaagaactgcgacgtaaactcgcggcaccgattatgggcaaaaatggcccagaagagattgatgctacggcagaagattacgagcgcgttattgcctggtgccatgaacatggctatctcgatgacagccgatttgttgcgcgctttatcgccagccgtagccgcaaaggttatggacctgcgcgtattcgccaggaactgaatcagaaaggtatttcccgcgaagcgacagaaaaagcgatgcgtgaatgtgacatcgactggtgcgcactggcgcgcgatcaggcgacgcgaaaatatggcgaacctttgccaactgtcttttcagaaaaagttaagatccagcgttttctgctctatcgtggctatctgatggaagatatccaggagatttggcgaaattttgccgactga

SEQ ID NO: 6545 - DNA, 384 bp, Shewanella oneidensis
gtgctcgatgattgtgaagcgtctggatttatcaatgataagcgctatgctgagctcctcgttcgtagcaacatcgcccgcggccatgggcctatacgcattcgtcaagccatcgctcaaaaagggcttactaaggattgtatcgaggctgcgttaatagcgactgattatgattggttcgaattagccaaagccaaagccaaagccaaagccatcaaaaaatatggtgtccctaaagtgacagaggttaaggggtctcaatcacgagagttgattgcaaaagaaaaagccaagcgggtgcggtttttattgagccaaggttttagttatgaacaagtcatctatgccttagattatgaccctttggaagataatgatgactaa

SEQ ID NO: 6546 - DNA, 480 bp, Geobacter sulfurreducens
atgcattcccgaccggagcggcggcgtgacccgttgtccaccgccctcgacatcctttcgcgtcgggaccacagcgaagccgaacttgcccgcaagctgaggtccagggggatcgacgcgggggagatcgaccgcatcgtcgcgcgcctcagggagttcggctacctgaatgaccgccgtgttgcctgccgcctggcggaatcggccctggcccaggggaaaatggtgggggctcgactccgggtcgagctgcgccgccgcgggattccaccggaactggccgaagaggccctggcccaggcggcggccggttgcgacgaacgggccttggtcggagacctgctggcccggaaatttcccggcttcgatccggctgtggcggaccctcgcgaaaagcggcgggtggtgggctggttccagcgccgcgggttcgggctcagtgccattcttgaagcgctccggtgtcctgtcgatgaatga

SEQ ID NO: 6547 - DNA, 417 bp, Methylococcus capsulatus Bath
ttggcgcggcgcgaacacagccggctcgagctccagcgcaagctcgccgcccgtggtttcgaattcccgacgatagcagccgttctggccgagtgttcggaccgggggtggcagagcgatgcccgttttgccgaaggtttcgtgtgcgcccgcaaggcgaaagggtacggcgtcaacaggattcgtcaggaactgcggctgcgcggggtcgaggcggaccttgcggattccagggactggatgacggacatggatcgtgtctatacgaagaaatatcgcggaaaacttgcggtgacgacgcctcgggagcgtgcgtcaagggcgagatttctcgcgcaacggggtttcacgtcctcccagatccgggattttttcgagcgtctgggagtggacggcgaatacccggacaccgattga

SEQ ID NO: 6548 - DNA, 453 bp, Nitrosococcus oceani ATCC 19707
gtggacgacgcaagcctagtagaggctagaaatctgttgctagggatgttggcccggcgggaatattcctgttgggaattgcaacgtaagcttactgctcgcggctattcttcgagcctgattgagaaggtactgagggaactgtggcaagataacttacaaagcgatcaacgttttgccgaaagctattctcggtcccgggcggaacgtggttttggaccccgtcgtatcgcggctgaactcaagcaacggggtgttagcgcagtgctgattaccgagagcctaacccaggagagagactgggacagtcaagtaatgaaagcccggaataagcgctttgggcaagcgcttcccactaaccctaaggagcgggccagacagatgcgtttcctgcaataccgggggtttacccaggaacaaattaatcatgcgttaagcgaaagggatagctga

SEQ ID NO: 6549 - DNA, 516 bp, Pelobacter carbinolicus
ttgacaagaagagtgaagaatcggaagaagaagattcggacatcctgcgcaaccatggcacctcgaactgatgcctggagcagcgccctgcgcctgctttcgcgcagggaatactccgaagccatgctgcgcgagcgattgcagcgtaaaggcttcgacagtgaccagatcgaacatgcgctggaacgctgccgcagttacaactacgtaaacgacgaacgctttgcccggatacgggcccgtcagttgctggcctccggccgtgccgtcggccccgccctgatggccgacctgagacatcagcgtatcggcgacagcatcgcccgcaaggctatcaacgatttggaggaggaattcagccaggccgagattttaaaagacctgtgccagcgccgttttccagatttcgattttcaaacagccgatgaccgttcgcgacgcagggtattcaattacctgaggcggcgcggctttgcctcggcagttctgtttcaatatttcagcgaagagaggtag

SEQ ID NO: 6550 - DNA, 468 bp, Geobacter metallireducens GS-15
atgggggaggagcggagcgggttcagccgcgcccttgatattctctcccggcgtgaccacagcgaggcggagttggccctgaagctgcggcgcaaggggatcgacgaaagagagattgcatcagtcgtggcccgcctgcgggagttggggtatctcaacgaccggcgcctggccgagcggatagcggaaacggccatggccggcggcaggatggcgggaccgcggctcagccgggaactcatccggcgcggaatccccagggagcttgcggccgaggccctggccagggccaccgaagggcgcgatctgcgggatgacataagggagatgctggccggcaagttctcatccttcgacccaagggaggcggatttacgggagaaacggcgggtggtcggctggttccagcgtcgcggctatcccctttcggccatcctggatgccctgcgggtttccgccgacgaataa

SEQ ID NO: 6551 - DNA, 477 bp, Thiomicrospira crunogena XCL-2
atggaaagcgagcaggacaaacgacaggagttggcgcaacagctggaaagccgagcggtttatttgctgtcgatgcgtgagcatggccgaaaagagttaacgaataagttgattcaaaaaattgcgggtgttgaagattacccaggcctggtcgattttgtgctcgataagtgtgtcgaaaataactggttatcagatgaacgttatattgaaacgtatgttcgacaagctatggaaaaaggtcaagggccttataaaattcgacagacgttgcggcaacgaacccatcgcgacgatttgattgatgcttatttagcgatggacgattcggattgggccgacttggcaaaagacgccttactgaaaaaatatggagagcctgttcattcattagagcgaaaagaacaggccagaagaatgcggtttcttcaatcacgcggttttagccaatcgcagatatggaaagcgtttaattaa

SEQ ID NO: 6552 - DNA, 468 bp, Methylobacillus flagellatus KT
atgaagaaagcgacgaataagcctaccaccagcctgcgagagcgggctttggcatatctggcacgacgagaatattcctatcaggagttgctgcacaagctgagcccccatgcgggagaggaagacaacctccctgccctgctggaagacttcaagaaacgcggttggttatccgatacccgttatacggagcagatcgtacatgcccgcaagggccgctacggcagcctgcgcgtggcgcatgagctcaggcagcatggcatcagtgacgagctgataggcaaggccgtggccgagatggccccgaacgaactggaagccgccacggcggtttaccgcaagaagtttccccaaccgccgcaatcacgggaggaatgggccaaacaggcgcgcttcctgcaagggcgcggcttcggttttgaagtgatacgccaggtgctgcgtggcagccctgaagatattgaatga

SEQ ID NO: 6553 - DNA, 459 bp, Chromohalobacter salexigens DSM 3043
atgagcacgcaggaggcgacgccccgcgacgatgccatccgcctgctggcgaggcgcgactactcgcgcagcgagttgatgtcgcgcctcgcggcgcgtgggcatgcgcccgacgacatcgcgtcgctactcgatgccctggccgatgaggggctgcagtccgacgctcgcttcgccgagcaattcgtgcgctcgcgcctgtcgcgcggccagggggcgatgaagatacgcgccgagctgggcgcgcgcggcgtcaccgacgaggtggcacgcgaggcactggaaggcgaggccccggactggcaccggctggcatgcgaggcgctggccaagcgcttcgattcccccgggcgcgaccctcgtgagcgcgccaagcgcgaacgctttctggcctcgcgtggattcgatttcgagcaggtgcgtcatgccatggcgcacgcctgggagaacacccgctag

SEQ ID NO: 6554 - DNA, 468 bp, Pseudoalteromonas atlantica T6c
gtgaatatattacctgatatgacagataacgacagtaagaacattaaatatagtattaccaaatatttatcgatgcgcgagcatagttgtcacgaattgttgcagaaattgacagctaaggggtatgacaaggggttatgcgaagagcgtattgctcaatttaacaaagcagacgttcaaagcgaactacgttatgccgagatgattgtgcgcagccgagtagcaaaaggtaaaggtgaaaaaatcatacgtagtgagctgagtcagcacgctattgcgcctgagctcatcgacattgctattaccgagcaagagatcgattgggatgcgctcgccattcaagtagctgaaaaaaagtttggccataagcccgcgaaggattggcaggagcaacaaaagcgtaatcgttttatgcaatacagaggctttagccatgaacaaattcgggcaatgaaaagcgtgcgctaa

SEQ ID NO: 6555 - DNA, 459 bp, Shewanella sp. MR-7
gtgctgttagcgcgccgcgactattcccgccaagaaatccgcacaaaactgcttgaaaaaggctttgaagtcgttgatatcgatcccgtgctcgatgattgtgaatcgtcaggatttataaatgataaacgttatgctgagctgctcgtaagaagccatattgcccgtggtcatgggcctatccgtattcgtcaagccattgcccaaaaggggctttcaaaggattgtatcgaagccgcgttatctgcaaatgatcatgattggtttgagttagcaaaagccaaagccatcaaaaaatatgctatccctaaagtcaccgaggttaagggttcacaatcccgcgaactagtggcgaaagaaaaagccaaacgggtgcggtttttactgagccaaggctttaattacgaacaagtctcttatgctttagattacgaccccttggcagataatgatgattaa

SEQ ID NO: 6556 - DNA, 372 bp, Shewanella sp. MR-4
gtgctcgatgattgtgaagcatcgggttttatcaatgataaacgttatgctgagctgctcgtaagaagccatattgcccgtggtcatgggcctatccgtattcgtcaagccattgcccaaaaggggctttcaaaggattgtatcgaagccgcgttatctgtaaatgatcatgattggtttgagttagcaaaagccaaagccatcaaaaaatatgctacccctaaagtcaccgcggtaaaaggctcacaatcccgcgagctagtggcgaaagaaaaagccaaacgggtgcggtttttactgagccaaggctttaattacgaacaagtctcctatgctttagattacgaccccttggcagataatgatgactaa

SEQ ID NO: 6557 - DNA, 459 bp, Alkalilimnicola ehrlichei MLHE-1
ttggagcgcgaagccgaggtgcgcgagcaggccatccgcctgctcgcgcggcgtgagcattccgtccgcgaactcgccttcaagctgacccggcgaggggttcccgaggaactggccgacgccgtcatcgcccgcttggcgcaggaggggctgcagagcgacgcccgctatgccgagagctgggtccgccaccgtgtggagcaggggtacgggccgctgcggatccgtgccgagttgcgcgagcggggcgtggccgatgccgtggccggcccggcattggcagaggtggagcggcagatcgactgggcagacctggcccgtcaggtgtgggcccgccgttttgggacggccccggcggacctgcgggagcgggcccggcagcagcgctatctggaacgaagggggtttgccgccgggcatatccggcaggtgatgtcggcggcggcacagcccgattaa

SEQ ID NO: 6558 - DNA, 453 bp, Magnetococcus MC-1
atgactgagatagaactctatgagcaagcgttgcgctggcttggccgccgggaatatggcgaaatggagctgcgcaaccgcctgcgcacgctgcccgaagtctctctggagctggtcaataaggtggtggagcgcctacttgccatggactatctcagtgatgtgcgctttgccgaggcgctggtgcgtgatcgcacccggcggggccaaggcagcctgcgtattcgccatgaactgcaacaaaaaggggtgcctgcccttattatcgaaagcagcctcgccgagctggcccctaatgataccgcccaagaaaatgcccaccgagccttggtaaaacggtttggccccacccccccagaagatctgaaagcccgtaaaaaacgccacgattttttgacaagaaggggttttgatgggcaaaccattcggatggttcttgaagccttgggctga

SEQ ID NO: 6559 - DNA, 372 bp, Shewanella sp. ANA-3
gtgctcgatgattgtgaagcatcgggttttatcaatgataagcgctatgccgagcttctcgttcgcagccatattgcccgtggtcatgggcctatccgtattcgtcaagccattgcccaaaaggggcttttaaaggattgtatcgaagccgcgttatctgcaaatgatcatgattggtttgagctagcaaaagctaaagccatcaaaaaatatgctatcccaaaagtcaccgaggtcaaaggctcacaatcccgcgagctggtggcgaaagaaaaagccaaacgggtgcggtttttactgagccaaggctttaattacgaacaagtctcctacgccttagattacgaccctatggaagataatgatgactaa

SEQ ID NO: 6560 - DNA, 492 bp, Pelobacter propionicus DSM 2379
ttgacgacaagatcgagatcgaaaaatactgacccatcctctcccgaacaggggaggcagtacgccctgagactcctggccggccgcgactacacggttgccgccttgaaacagaagcttcgtgccaggcagttgcgggaggaggatctggagcaggtggtttcgcggctggaagaggaagggtggctcagcgaccgccgctttgccgaacgcttctccgagtcggcgctgacctcgggccgctacgtcggcgtgcgcctgaggcaggaaatgctccggcgtggggtgcccgaagagctgattgacgagcagctggcccgtctctgccttgatcatgacgaggatgaacaggcgtgccagatgctggccaaacggtttcccgctttcaccttcgcggcatccggcgaccacgaaaaacgccgcgtggccggatttctgcaacgccgcggcttccgcttttccacggtcatgcgagccatgaggaacgcatag

SEQ ID NO: 6561 - DNA, 438 bp, Shewanella amazonensis SB2B
atgaatcacgcgctggcatcccttgccaggcgtgatcacagccgcaatgaactcaagcttaaattgctcgccaaaggacacaatgccctggacattgagcgggtgctggatgagtgtgaagctaaaggctacctgaatgacagtcgttatggagcatcagtcgttcgctcatcggtactgaaaggtcatggcgctgccagagcgcgccaggcaatgatagccaagggattggataaagaggttattcaacacaatctggaaggttgcgaggtggattggtatgcccaggcccgggctaaggcgctgaaaaaatttggtgcgaccaaacctgtcgatgccaaggacagggcaaagcgtatacgctatcttgccggacaaggattcagttttgacgagattgcccacgctctggattttgacccttacgatatggaatga

SEQ ID NO: 6562 - DNA, 486 bp, Halorhodospira halophila SL1
atgagcgaggccggggcggcatccgaggcggtacgtgatgccgccctgcgtttgttggcccggcgcgagcacacgcggcgtgagctggctcagaagctggcccggcgtggccacgaccccgggtatgtgcacccggtgctcgaggcactggccgaggaggggctgctggatgaagggcggttcgcggaggtctttgtgcgcagtcgcgtggagcgcggccagggaccggtgcgcatcgcccaggagctgcgtcagcgcggcgtggcggacggagtgatcgacgaggtactggaggacgccgaagtcgactggctggcacaggcccgtgcggtccgtgagcgccgcttcggcgcgggcgtgccggcggatcggcgagaggcgctgcggcaggcacaattcctgcagcggcgagggttcacagcggatcaggtgcgcgcggctgcggccgccgcggacgaagacgacgaaaggggcccgtatgggtga

SEQ ID NO: 6563 - DNA, 414 bp, Shewanella baltica OS155
ttgctcgaaaaaggtttcgaactgaatgatatcgaacctgtgctcgatgcttgcgaatcctccggttttatcaatgataatcgctatgctgaactgttggtccgtagccacattagtcgaggccacggtgccatccgcattcgccaagcgatagcgcaaaaaggcctgtctaaagattgcattgaagcggcgataaccaatagtgattgtgactggtttgagctagcaaaagataaagccactaaaaaatatggaattcctcgcgtaacagaagtgaagggctctacagcccgggatctcatcgcgcaggaaaaggctaaacgagtgcggtttttaatgggccaaggctttagctacgatcaaatcacttatgcgttagattcagatcccaatgatctcgacgacgattattaa

SEQ ID NO: 6564 - DNA, 453 bp, Shewanella loihica PV-4
atgactatgtcggcgatgcaagtcgcggtgggcctcctggcccgccgcgattattcccgctatcagataaagagtaagctgagccagaaaggctttctggacggcgagatagaggctgtccttggtcaatgtgaaagccagggatatctcgatgatgccaggtttgccgggctcttgttacgctctcatatcgctaaaggccatggccagaacaagatacgtcaatctatgtcccagaaggggctgaccaaagagattatcgagtctagcctcaatcagagtgactgcgactggttcgaactggcgagacagaaggctgctaagaaatatgccactagcggccccattcaagatcagaaagagcgcgccaaacgagtgcgttatcttctctcccaaggctttggcttcgatcaggttgcctatgctttagaggtcgatccagacttcgactaa

SEQ ID NO: 6565 - DNA, 501 bp, Enterobacter sp. 638
atgagtgaatcgaaaccgcgtcgtcctgcatacgcccgtttattagaccgtgccgtacgaattctgggcgtacgcgatcacagtgaacaagaactgcgacgcaaactagccgcccccgtcataggtaaaaatggcccggaagcgattgatgcaaccgaggaagactatgaccgcgtgatcgcctggtgctatgagcacagctaccttgatgacacccgttttgtgacgcgctttatcgccagccggagccgtaaaggttacggtcccgcacgcatccgtcaggaacttaatcagaaagggatcgcacgcgacgcaacagaacaggcgatgcgtgaatgcgatatagactggggtgaactggcgagggatcaggccgttcgtaagtacggtgaacctttgccgagtgaattttcagaaaaagtaaaaatccagcgtttcttactctatcgtggctacctgatggaagatattcaggcgatatggcgtaattttactgattga

SEQ ID NO: 6566 - DNA, 414 bp, Shewanella putrefaciens CN-32
ttgctcgataaaggtttcgaactaaacgatatagaacctgtactcgatgcttgcgaatcctccggttttattaatgatgctcgttatgccgaactgttggtgcgaagccacatcagtcgaggccacggtgcaatacgcatccgccaagcaatcgcacagaaaggcttatctaaagactgtattgaagccgctttggttaattgtgattgtgactggtttgagctagcaaaagataaagccaccaaaaaatacggcattccccgtgtgacagaagtgaagggctctaaagctcgggatctcatcgcaaaggaaaaggccaaacgagtgcgttttttaatgggccaaggctttagctacgatcaaatcagttatgcattagattcagatcccaatgatctcgacgaagatgattaa

SEQ ID NO: 6567 - DNA, 459 bp, Vibrio cholerae O395
atgagtttcgacttagccacttgccgacaaagtgccttgcaacttctgagtcgccgcgatcatagcgaatatgagctacaccaaaaattagccctcaaaggtcatcctacagaagtgattgatgaggttgtgaagtacgttttagagctagggtatttgagtgatgcccgttacgcagcgagtcaggctcgacaaatcgttcataaaggttacggtgagcagcgtttgcgccagcaactcaaagaaaagcgggtcgcggaagaggtgattgagcaagccctcgccgagcaaacgatagattggtttgaactagcgaaagaggtcgcacacaagaaattcaaaagcggcatcagccacgagcgctcgcaatacgccaaacaagttcggtacttacagtaccgtggtttcaactttgagcaaatacgttatgcacttcaagccagtgagagtgatgagtaa

SEQ ID NO: 6568 - DNA, 459 bp, Geobacter uraniumreducens Rf4
gtggaagaaagtggcaaagccttggccagtgccctccgaacgctcacccgccgggaccacagcgaggtggaactccggcgcaaattgcaggacaaaggtttcgccgggggagaggttgacgcggcaatcggcaagctgaaggcgttgggttatctggacgacaggcgctttgccgggcagtgggcggaatccgccatccgcaatggacgtggttttggcccgcgcatccgcctggaacttcgtcggcggggggtttcggacagcgttatcgcagatgtgtttgcccggctggcggaggactacggggaggaggaaaccctggcggcactcctggcgaggaaattcgccggcttcaaaccgaacagcgccgatgatcgggaaaagcgacgcgtcatcggctatctgcagcggcggggattttccatcgctgctatactgaatgtttttagagagcagtaa

SEQ ID NO: 6569 - DNA, 414 bp, Shewanella baltica OS185
ttgctcgaaaaaggcttcgaacttaacgatatcgaacctgtgctcgatgcatgtgaatcctccggttttatcaatgacaatcgttatgccgaattgttggtccgtagccacattagtcgaggccacggtgccattcgtattcgccaagcgatagcgcaaaaaggcctgtctaaagattgcattgaagcggcgataaccaatagtgattgtgactggtttgagctagcaaaagataaagccaccaaaaagtatggtgttccccgcgtaacagaagtgaagggctctaaagcccgggatctcatcgcgaaggaaaaggccaaacgagtgcggtttttaatgggccaaggctttagctacgatcaaatcacttatgcgttagattcagatcccaatgatctcgacgacgattattaa

SEQ ID NO: 6570 - DNA, 549 bp, Yersinia pseudotuberculosis IP 31758
atgaatgaccagttaagtcgtgcaatgagactactctcccagcgtgaccatagtgaatctgaactgcgtcgcaagcttgcggcacctccattttcggcaaaagggaattggggaaagcgttcaggtgctaaaagcagtaatctagttgaaagtaacccagttgaaagcaatttagctgaaagtaatgcaattgaagagagtgatcctcaggttatcgagcaggttattgactattgttatcagcacaattggttggatgattcccgttttgccgccagctatattaatagtcgtagccgtaaaggatatggcgtacagcgtatccgttcagaactgatgcaaaaaggtgtcgataaagaacgaattctggctgcttttgagaacagtgagatcgactggtgccaactggcaaaagaggtcgcccagcgtaaatttagtgaaactttacctgttgaatggaaagaaaaggctaaagttcagcgttatctcctctatcgtggcttcttccaagaagaaattcagtcgatttacactgattctgtcgaatga

SEQ ID NO: 6571 - DNA, 468 bp, Vibrio harveyi ATCC BAA-1116
atgtaccaaaagcttcaagcgccgaccttatccagcaaagaagcggctatccaattattaagccgtcgagatcatgggcaatacgagctataccaaaagttagctctaaaaggttatgaagaagcagacatcgaagcggccattaatttttgtctcgaccacaattatttggatgatctgcgttatgcaaaaagccaagtgcgccagcatgtttacaaaggtcacggtgagcgccgcattcgtcaagaattgaagcaaaagcgtgtggcagaatccatcattgatatggcgatggcagaagagccacaagactggtttgaactggcaagaatggctgcagagaagaaattcaaaggaataaaagccaaagaccagaaagagtacgctaaacaggtgcgatttctgcaatatcgtggctacagttttgaccaaatcagctatgcgctgagctttgaggacgaagattag

SEQ ID NO: 6572 - DNA, 501 bp, Escherichia coli HS; identical to SEQ ID NO: 6544

SEQ ID NO: 6573 - DNA, 507 bp, Serratia proteamaculans 568
atgaatgacttgctaagccgcgccatgcgcctgctgtcgcaacgcgatcatagtgaagctgaactgcgccgcaaacttgcggcgcagccatttatggcgaaagccagatttggcaccaaaactccctcgtcctccgctccgctgcctgaagaacccgttgaccctgccgttatagaacaggttattgcctattgttaccagcataactggctggacgatcaacgctttgcccgcagttatattggtagccgcagccgtaaaggctatggcgcgcagcggatccgctccgaattgatgcaaaaaggtgtggataaggaactgacgcaggcggcgctggcggactgcgagattgattggtgtgaacaggccaaacaggtggcgcagcgtaaatttggcgatcaactgccaacggactggaaagagaaagccaaagtgcagcgttatctgctctatcgtggcttcttccaggaagaaattcagtcaatttaccgtgattttgcgcaatga

SEQ ID NO: 6574 - DNA, 414 bp, Shewanella baltica OS195
ttgctcgaaaaaggcttcgaacttaacgatatcgaacctgtgctcgatgcatgtgaatcctccggttttatcaatgacaatcgttatgccgaattgttggtccgtagccacattagtcgaggccacggcgcgattcgtattcgccaagcgatagcgcaaaaaggcctgtctaaagattgcattgaagcggcgataaccaatagtgattgtgactggtttgagctagcaaaagataaagccactaaaaaatatggaattccccgcgtaacagaagtgaagggctctaaagcccgggatctcatcgcgaaggaaaaggccaaacgagtgcggtttttaatgggccaaggctttagctacgatcaaatcacttatgcgttagattccgatcccaatgatctcgacgacgattattaa

SEQ ID NO: 6575 - DNA, 435 bp, Coxiella burnetii RSA 331
atgacggatttgcgtaatcgcgcaatttcctttttggcgaggcgcgaacattcacaagaagaattaaagcgaaaactcgttacgagaggctacaagcttccagaaattgaaaccgagttggcatccctggccagggaaggccttcaaagcgatgagcgatatgccgaagcctacgtgcgccagcgcattgaatctggcttcggccgtcgccgaatcatcgcagaactccaacagcgaggtattgagaattctttaattcagcaatatctgccccgtgacgaatcgttttggtttgaaacattgtcttcggtttggaaaaacaaatatggatatcaaagtgtaaagggaaaaccatctgccaatcaggtgcgtttcctactgcaacgaggatttgatttagaacaaatttataaactttttaaaaaaaatgaatag

SEQ ID NO: 6576 - DNA, 501 bp, Escherichia coli C ATCC 8739; identical to SEQ ID NO: 6544

SEQ ID NO: 6577 - DNA, 564 bp, Yersinia pseudotuberculosis YPIII
atgaatgaccagttaagtcgtgcaatgagactactctcccagcgtgaccatagtgaatctgagctgcgtcgcaagcttgcggcacctccattttcggcaaaagggaattggggaaagcgttcaggtgctaaaagcagtgatgtagttgaaagtaatctagttgaaagtaacccagttgaaagcaatttagctgaaagtaatgcaattgaagagagtgatcctcaggttatcgagcaggttattgactattgttatcagcacaattggttggatgattcccgttttgccgccagctatattaatagtcgtagccgtaaaggatatggcgtacagcgtatccgttcagaactgatgcaaaaaggtgtcgataaagaacgaattctggctgcttttgagaacagtgagatcgactggtgccaactggcaaaagaggtcgcccagcgtaaatttagtgaaactttacctgttgaatggaaagaaaaggctaaagttcagcgttatctcctctatcgtggcttcttccaagaagaaattcagtcaatttacactgattctgtcgaatga

SEQ ID NO: 6578 - DNA, 501 bp, Escherichia coli SMS 3 5
atgacagaatcaacatcccttcgcccggcatatgctcgcctgttggatcgtgcggtacgcattctggcggtgcgcgatcacagtgagcaagaactgcgacgtaaactcgcggcaccgattatgggcaaaaatggcccggaagagattgatgccacggcagaagattacgagcgcgttattgcctggtgccatgaacatggctatcttgatgacagccgatttgttgcgcgctttatcgccagccgtagccgcaaaggttatggacctgcgcgtattcgtcaggaactgaatcagaaaggtatttcccgcgaagcgacagaaaaagcgatgcgtgaatgtgacatcgactggtgcgcactggcgcgcgatcaggcgacgcgaaaatatggcgaacctttgccaactgtcttttcagaaaaagttaagatccagcgttttctgctctatcgtggctatctgatggaagatatccaggatatttggcgaaattttgccgactga

SEQ ID NO: 6579 - DNA, 489 bp, Xanthomonas oryzae PXO99A
atgaacgagcaagagcccgcaccaaaacgggggcgccggttcaaggagcagacgccggtccagcgcgcactcggtctattggtgcggcgcgaacattcgcgcaaggaattgaaccgcaagctattagcccgcgggatcgagccagatgcggcgcaagccgccgtcgatcgcctcactggcgaagggtggcaggacgacgcccgtttcgcagcagcagtcgtgcgcaatcgcgccggctccggttatggcccgctgcatattcgtgccgaactgggaacccatggtctggatagcgaggccatcagtgccgccatggcgacgtttcaaggcgattggaccgaaaacgcgcgcgatctgatccaccgtcgtttcggcgagcagggcccaatagaccttccacagcggcgcaaagccgccgattggctggctcggcgtggtttcgacggcaacagcattcgcgccgccacgcgcttcgaccttgaggactga

SEQ ID NO: 6580 - DNA, 501 bp, Shigella boydii CDC 3083 94
atgacagaatcaacgtcccgtcgcccggcatatgctcgcctgttggatcgtgcggtacacattctggcggtgcgcgatcacagtgagcaagaactgcgacgtaaactcgcggcaccgattatgggcaaaaatggcccagaagagattgatgctacggcagaagattacgagcgcgttattgcctggtgccatgaacatggctatctcgatgacagccgatttgttgcgcgctttatcgccagccgtagccgcaaaggttatggacctgcacgtattcgtcaggaactgaatcagaaaggtatttcccgcgaagcgacagaaaaagcgatgcgtgaatgtgacatcgactggtgcgcactggcgcgcgatcaggcgacgcgaaaatatggtgaacctttgccaactgtcttttcagaaaaagttaagatccagcgttttctgctctatcgtggctatctgatggaagatatccaggatatttggcgaaattttgccgactga

SEQ ID NO: 6581 - DNA, 492 bp, Stenotrophomonas maltophilia R551 3
atgtccgacgccgaagacattcccaccggccgcaagcgccggccgcgtgagcagaccccggtacaacgggcgctgggcctgctggtccgccgcgaacactcgcgcaaagagctgacccgcaagctgaccgcccgtggcatcgaggatgaggccgcgcaggctgctgttgccaagctgaccgaggcgggctggcaggatgacgcccgctttgccgagaacctggtgcggatgcgtgccaataccggctacgggccgatccacgtgcgcgccgagctcggcacccatggcctggacagcgaggcgatcgccgcggcgatggacagctatgaaggcgactggcaggagaacgcccgcgacctggtccgccgccgcttcggcgaaaccggcccgcaggacctggcgcagcgtcgcaaggctgcggacctgctggcccgacggggcttcgacggtgacagtatccgccgcgcgacccgctacgacccggatgactga

SEQ ID NO: 6582 - DNA, 501 bp, Salmonella enterica serovar Newport SL254
atgagtgaacccacatcgagccgtcccgcttatgctcgtctccttgatcgtgcggtacgtattcttgctgtccgcgatcacagcgagcaggaattacggcgtaaactctccgcgccggtgatgggcaaaaatgggccggaagagattgatgcgacggcagacgattatgaacgcgtgatcgcctggtgccacgaacatcactatcttgatgacgagcgcttcgtgatgcgctttatcgccagtcgtagccgtaaaggctatggcccggcgcgtattcgccaggagttgaatcagaaaggcatttcccgtgaatcgactgaaaaaacgatgcgagaatgtgaaattgactggagtgaaatggcacgtgaacaggccgttcgcaaatatggcgagccgctcccttcaaacttttcagaaaaggttaaggtacagcgctttttgctctatcgcgggtatctgatggacgatatccagcaaatatggcgaaattttgcagattga

SEQ ID NO: 6583 - DNA, 501 bp, Salmonella enterica serovar Heidelberg SL476
atgagtgaacccacatcgcgccgtcccgcttatgctcgtctccttgatcgtgcggtacgtattcttgctgtccgcgatcacagcgagcaggaattacggcgtaaactctccgcgccggtgatgggcaaaaatgggccggaagagattgatgcgacggcagacgattatgaacgcgtgatcgcctggtgccacgaacatcactatcttgatgacgagcgcttcgtgatgcgctttatcgccagtcgtagccgcaaaggctatggcccggcgcgtatttgccaggagttgaatcagaaaggcatttcccgtgaatcgactgaaaaagcgatgcgagaatgtgaaattgactggagtgaaatggcacatgaacaggccgttcgcaaatatggcgagccgctcccttcaaacttttcagaaaaggttaaggtacagcgctttttgctctatcgcgggtatctgatggacgatatccagcaaatatggcgaaattttgcagattga

SEQ ID NO: 6584 - DNA, 501 bp, Salmonella enterica serovar Schwarzengrund CVM19633
atgagtgaacccacatcgcgccgtcccgcttatgctcgtctccttgatcgtgcggtacgtattcttgctgtccgcgatcacagcgagcaggaattacggcgtaaactctccgcgccggtgatgggcaaaaatgggccggaagagattgatgcgacggcagacgattatgaacgcgtgatcgcctggtgccacgaacatcactatcttgatgacgagcgcttcgtgatgcgctttatcgccagtcgtagccgcaaaggctatggcccggcgcgtattcgccaggagttgaatcagaaaggcatttcccgtgaatcgactgaaaaagcaatgcgagaatgtgaaattgactggagtgaaatggcacgtgaacaggccattcgcaaatatggcgagccgctcccttcaaacttttcagaaaaggttaaggtacagcgctttttgctctatcgcgggtatctgatggacgatatccagcaaatatggcgaaattttgcagattga

SEQ ID NO: 6585 - DNA, 462 bp, Alteromonas macleodii  Deep ecotype
atgtcagactttgaccgaaaaatcattaccgacgcgattactcgcatgctggcacgacgagagcatagcgttaatgaaatagcacgaaagctgcaacaaaagggaatagcaagcgaggcgtttacgcctattttagacgagtttaaggatgcaggaattcaaagcgatacgcgttttgcagaaagtagagcccgcgccctttatatgaaaggtaaaggtcctcgcgctatcaagttagacttgcagcaatacggtgttgatgagggaacggcagagcaggcgttaaacgaaattgaagccgactggtttgaaagcgcgagaaacgtaaaggtaaagaagtttggcgagttttacgaaactgaatttgcgttaaggcaaaagcagaaacagtttcttcaatatcgcggtttttaccaagatcatatcgattacgcggtcagcgagagtagctgcgagaactaa

SEQ ID NO: 6586 - DNA, 471 bp, Geobacter bemidjiensis Bem
gtgcagcggggaagcgccttcgactgctgcctgagggtgctggccctgcgcgaccacgccgaggcggaactgcgcaggaaactggaaaggaagggttaccaggaggaagaggtcgaggcgagcgtcgtccggctgaaggaacttggttacctcgacgacctccgcttcgcccgtgccttcgccgcctcgcagcttagaaacggcaaggggtacggggtgcggctgaagatggagctcgcccgtcgcggcgtcgccgcagccatcgtcgacgaggtgctcagcgagctggcacaggagtacggcgagtccgatctgctggcccaggtgatggagcgccgttacgcctccttcgacccaacgaccgcgacggacaaggaaaagcgcaaggtgatcggctacctgcagcggaagggattttccctctcggcgattttcaagaagcttgacgggcacggctgctgcgacgagtaa

SEQ ID NO: 6587 - DNA, 501 bp, Salmonella enterica serovar Agona SL483
atgagtgaacccacatcgcgccgtcccgcttatgctcgtctccttgatcgtgcggtacgtattcttgctgtccgcgatcacagcgagcaggaattacggcgtaaactctccgcgccggtgatgggcaaaaatgggccggaagagattgatgcgacggcagacgattatgaacgcgtgatcgcctggtgccacgaacatcactatcttgatgacgagcgcttcgtgatgcgctttatcgccagtcgtagccgcaaaggctatggcccggcgcgtattcgccaggagttgaatcagaaaggcatttcccgtgaatcgactgaaaaagcgatgcgagaatgtgaaattgactggagtgaaatggcacgtgaacaggccgttcgcaaatatggcgagccgctcccttcaaacttttcagaaaaggttaaggtacagcgctttttgctctatcgcgggtatctgatggacgatatccagcaaatatggcgaaattttgcagattga

SEQ ID NO: 6588 - DNA, 453 bp, Acidithiobacillus ferrooxidans ATCC 53993
ttgacgacagaacgcagcgatcccaccgcgctggcgctacggttgctggcgcgccgggagtatgggcgccgggagttgggtgacaaactgctccgtgcgggatgtgacgcaggggacgtggcgctggcgctggatgcgctcgccgccgccggttatcaggatgacgcgcgttatgtggaaatgctcacccgtacccgtgtgcgtcaggggcacgggcccttgcgcttgcgtcaggacttgcagcgggcggggatcgaggttggcgcagaccccgagattgactggttgcagcaagcgcaagccgtctgtcggaagcgtttcggcaacacgccgccggcggacgccagagattatgcccggcgcgcccgtttcctggcggggcggggatttaccggagagacgattcgccaggtgctgggcgccggcagagaaagggatttcgctgccgattga

SEQ ID NO: 6589 - DNA, 501 bp, Salmonella enterica serovar Dublin CT 02021853; identical to SEQ ID NO: 6587

SEQ ID NO: 6590 - DNA, 501 bp, Escherichia coli O157 H7 EC4115
atgacagaatcaacgtcccgtcgcccggcatatgctcgcctgttggatcgtgcggtacgcattctggcggtgcgcgatcacagtgagcaagaactgcgacgtaaactcgcggcaccgattatgggcaaaaatggcccagaagagattgatgctacggcagaagattacgagcgcgttattgcctggtgccatgaacatggctatctcgatgacagccgatttgttgcgcgctttatcgccagccgtagccgcaaaggttatggacctgcgcgtattcgccaggaactgaatcagaaaggtatttcccgcgaagcgacagaaaaagcgatgcgtgaatgtgacatcgactggtgcgcactggcgcgcgatcaggcgacgcgaaaatatggtgaacctttgccaactgtcttttcagaaaaagttaagatccagcgttttctgctctatcgtggctatctgatggaagatatccaggatatttggcgaaattttgccgactga

SEQ ID NO: 6591 - DNA, 492 bp, Shewanella baltica OS223
ctgagtcagtcagcccgtcaaatcgcggtcgcgctgttagcgcgccgcgattattcccgcctacaaatccgcgataaattactcgaaaaaggcttcgaactgaatgatatcgaacctgtgctcgatgcttgtgaatcctccggttttatcaatgacaatcgttatgccgaattgttggttcgtagccacattagtcgaggccacggtgccattcgtattcgccaagcgatagcgcaaaaaggcttgtctaaagattgcattgaagcggcgataatcaatagcgattgtgactggtttgagctagcaaaagataaagccaccaaaaagtatggtgttccccgcgtaacagaagtgaagggctctaaagcccgggagctcatcgcgaaggaaaaggccaaacgagtgcggtttttaatgggccaaggctttagctacgatcaaatcacttatgcgttagattcagatcccaatgatctcgacgacgattattaa

SEQ ID NO: 6592 - DNA, 453 bp, Acidithiobacillus ferrooxidans ATCC 23270; identical to SEQ ID NO: 6588

SEQ ID NO: 6593 - DNA, 471 bp, Thioalkalivibrio HL EbGR7
atgaggcggaatcggcggaggcctgaggaccccgctgagccgggcgatccctacgccgacggcgtgcgactcctggcgcgccgcgagcacagccgctcggagctgcgtcgcaagcttgcccacaagggccatgagcccgaggcactggacgaggccctggaccggctcgcggcgcagcgataccagagcgacgcgcgtttcgtggaaaccttcgtgcgccaccgggtccaacagggttacggtccggtgcgtatcgccgccgagttgcgcgaacggggcattggggagtccgagtctgaggcgggtattgccgccgccggggccgactggcagcagcttgccgaggaggccttgcatcggcgcttcggcgacttgccccccgaagatgcccgggaatgggcgaaacgggcccgcttcctgcaatatcgtggtttctccgccgacctggtgcggcgggccctgaaaagatga

SEQ ID NO: 6594 - DNA, 489 bp, Dickeya dadantii Ech703
atgacgaagctattgcgttatgccatgaacatactggcggttcgggatcatagtgaatgggaattgcgccgcaaaattgcggcgcaacttcaaaatgatctggcgatagagtgctgtgatgaggatgccgtaccggcgcatgaaggttcgtatatcgaacaggttattgattactgtaaacagcatgcctggttggatgataaagcatttgccagccgttatattcgttcccgtattcgaaaaggttatggctcgcagcgaatttgcgctgaactgactcaaaaagggattgataaacacactcagcgagatgttttactggcgagtgatatcgattggtatcagttggcaaaagcatcagctacacgcaagtttggcatccccctttcctcagactggaaagaaaaagttaaggttcaacgttatctgctttaccgggggtttacctctgacgaaattcaatcggtttacatgaatttttccgattga

SEQ ID NO: 6595 - DNA, 489 bp, Dickeya zeae Ech1591
atgcctaacatactccgctatgtaatgaatgtgctggctgtacgggatcacagtgaaatggaattacgtcgcaagattgcgatgtatttgcaagcaaatcctgagtgtgatggtgcagatgcctgttctgcaccatccgaaattcatacccaaatcgagcatgcgatagcaagctgcaaacaacaagggtggctggatgatgggcgctatgcccagcgttatatcagcagtcgctgtcgtaaaggatacggttttcagcgtatctgtgtcgaactcagccagcgcggcattgataaatccatccagcgtatggcgcttcagtcttgtgatattgactggtattcgcaggcgaagaccgtcgcggaccgtaaattcggctcccctttgccgacgaattggcaggagcgagccaaagttcagcgctatttgctttatcgcggcttttcccacgacgaaattcagtcggtatatatgaatttttccgattga

SEQ ID NO: 6596 - DNA, 495 bp, Pectobacterium carotovorum PC1
atgaataaacccttacgctatgcgatgaatgtgctttctgttcgggattatagtgaagccgaaatacgccgcaaatgtgcggcgtatttatataaatcagaaagtgcagaagcagaagatgaagcggacgaagctactactcgatctgcagcagaagatgtggatgctgccattgcttactgcaaggaacacggttggctggatgatgcgcgctatgctcgtcgctatatcaacagccgaagtcgcaaaggctatggcgtccagcgaattaaaatggagctgagccagaaaggaatcgataagacgatattagccacggcattaaacgagagtgagatcgattggtgcgcgctggcgaaatcagttgttgagcgaaaattcgggcatcctctgtccgatgaatggaaagacaaagtcaaacatcagcgatatctgctctatcgtggcttctttcatgaagaaatccagtcaatttatacgaatttttcagattga

SEQ ID NO: 6597 - DNA, 465 bp, Geobacter M21
gtgcagcggggaagcgccttcgactgctgcctgagaatcctggccctgcgcgaccatgccgaggcggaactgcgcaggaaactggaaaggaagggttaccaggaagaagaggtcgaggcgggcgtcgcccggctgaaggaacttggttacctggacgacctccgcttcgcccgcagcttcgccgcctcgcagcttcgaaacggcaaggggtacggcgtgcggctgaagatggagctttcgcggcgcggcgtcgccgccgccatcgtcgacgaggtgctgggcgatctggctaaggagtacggcgagagcgagttgctggcccaggtgatggagcgccgttacggctccttcgacccaagcaccgcgacggacaaggaaaagcgcaaggtggtgggctacctgcagcggaagggtttttccctcggagcgatcttcaaaaaactaggggctagaggcaggggctag

SEQ ID NO: 6598 - DNA, 1008 bp, Polaromonas JS666
atgcggcgttgcttattcgcgtacaaggcaaaatcgcagcctatggcaaaccccaacacctcttcactggacagccggcaactgcaaaccgaggacagcgacgcgtctccggcatgcgtcatgaccttcaatgccaatgatccgagcggagcaggtggactgacggccgacatcgcagcgatcacctcggcgggggctcatccactggctgtcgtcaccggcgcgtacgtgcgcgacaccgccgagatttttgaccatttctcattcgacgaagaggctgtcaccgaccaggcgcgatccgcactcgaagacatgccggtgtcggccatcaaggtcggttttgtcggcagcccggagaacatcagcaccatcgccgagatcgcgaccgactatgccgatgtaccgcttatcgcttacatgcccaacctgtcatggtgggacgaaagcgaaattgacagctacctcgatgcctttcgtgagttgatgctgccgcagacgacagtgttggtcggcaaccacagcagcctgtggcgctggttgctgccggactggccgggcgagcgcaacccctcggctcgcgacattgccaaggctgcggccgacctgggcgtgccctacacgctggtgaccggcattcccctgcccgaccagttcatcgacaacgtgctggcgactccgcaagccgttttgtacagtgaaaaattcgagcgctttgaggcggtatttgccggcgccggcgaaacgctgtctgccgcactctcggccctgctggccaatggccacgatctgcaggcggccaccgccgaagccctgacctatctggaccacagcctggatgccggttttcaccccggcatgggcaacatcgtgcctgaccgcctgttctgggcgcaggccgatgtcgatgatgaagaatccgaagacgaagcgggcgacacgcccgacgatgccgcactgacatccaagcctccttttgacctgccgcccaatggaaccacaaaacattaa

SEQ ID NO: 6599 - DNA, 957 bp, Acidovorax avenae citrulli AAC00-1
atgaccacagattccccctccaagctcacccctcccccctcctccggcaccgacgacgacggcggggtccccatctgcgtgatggccttcaacgccagcgaccccagcggcgcgggcggcctgacgggcgacatcgccaccatcgcctcggtgggcgggcatgcggtggccgtcgtgaccggcgcgtacgtacgcgacaccgcgcaggtgttcgaccactacgcgctggacgacgaggccgtggcggagcaggcccgcagcgtgctcgaggacctgacggtgcaggcgatcaaggtcggcttcgtcggcagccccgagaacctcagcgccatcgcctccatcgcgtccgactacgacgacgtgccggtgatcgcctacatgcccaacctgtcgtggtggcgcgacgacctcatcgaccagtacctcgacgccttccaggaactgctgctgccccagacctcggtgctggtgggcaactacagcacgctttcgcgctggctgctgccggactggtccagcgaccgcaagccctccgcacgcgacctcgccatggccgcctccgaactcggggtgccctacctgctggtcaccggcattcccgcgcccgagcagcacgtcgagaacgtgctcacctccgcgcagaccgtgctcggcaccacgcgcttcgagctgttcgacgccaccttcaccggcgccggcgacacgctgtcggcggcgctcgccgcgctcgtggccagcggcaacgacctcgccgaagcggccagcgaagcgctcacctacctcgaccgctgcctggacgccggcttccggccgggcatgggccacatcctgcccgaccggatgttctgggcccagccggacgacgatgacgacgacgaagaccccgacgacggccccgggaccgatcccacgtccaccgacggcttcgtgatgcctccccatgacacccagcactga

SEQ ID NO: 6600 - DNA, 945 bp, Acidovorax sp. JS42
atgcaatcgaataccccttcagcacccgacagccaaagcttgacggcggatgacagcgaatccaccgcccccaccatctgcgtgatggttttcaatgcaaacgaccccagcggcgcgggaggattggcggccgatatttcggcggtgtcctcggtcggggggcatgtcgcgccggtggtgaccgggacctatgtgcgtgacagcgccgagatattcgaccattacgccttcgaagacgagacggtcgccgagcaggcccgtgccgtgctggaagacatgccgctgcacgcgatcaaggtcggcttcgtggggagccccgagaacctgagcgccatctccgagatcgccgccgactatgcggacgtgcccgtcatcgccttcatgccggacctgtcgtggtggcaggacgacctgatcgaccagtaccacgacgccttccgcgagctgttgctgccgcagacatcggtattggttggaaaccacagcaccctgtggcgctggctgctgccggactggggcagtgagcgcccaccctcggcacgcgacctggccatggcagtcgcggagataggcgtgccctatttattggtgaccggcattcccgcggcggagcggcatatcgacaatgtgctcgcctcaccgcagacggtgctgggcagcgggcgcttcgaacgctttgaagtgactttcatcggagcgggcgacaccctgtcggccaccctggcggcgctcattgccaccggcagcgacctgggcgaggccacgagcgaagcgctcacttacctggacggctgcctgcagcacggattccgccccggcatgggccatgtgctgcccgaccgcatgttctgggcccagcccgacgatgaggacaccgacgacgacgtatctccctccgcggtcgtggagggcttcgatttgccaccccatgacacacaacactga

SEQ ID NO: 6601 - DNA, 975 bp, Polaromonas naphthalenivorans CJ2
atggcaaacccccacacacctcaactggacagccggcaactccagatcgaggacagcgatgcatcaccggcatgcgtcatgacgttcaatgccaatgacccgagcggcgcaggcggcctcacggcggacatcacggccatcacctcggcaggcgctcatccgctgtccgtcgtgacaggcacctatctgcgtgacacggcagagatttttgaccacatctcattcgacgatgacgcagtaaccgaacaggcacgcgccgcgctggaagacatgccggtgtcagccatcaaggtcggctttgtcggaagtcccgagaacatcagcaccatcgccgaaatcgcctccgactactcggacgtgccgctggtggcctacatgcccagcctgtcgtggtgggatgaaaccgagatcgacagctacctcgatgcatttcgtgaactgatgctgccgcaggttaccctcctgattggcaaccacagcaccttgtggcgctggctgctgcccgactggtccacggaacgcaatccgtcagcccgcgatattgccaaggcagctgccgctctgggcgtgccttacacgctggtcacgggcattccgctgcccgaccagttcattgacaatgtgctggccacgccgcaggcggtgctgtacagcgaaaaattcgaacgctttgaagccgtcttcgaaggcgccggcgaaaccctgtcggccgccctttgcgccctgctggccaatggccacgatctgcaggcagccacggccgaagcgctgacctatctggaccacagcctggacgcgggctttcatccgggcatgggccacatcgtgccggaccgcctgttctgggcgcaggccgaggacgatgaagcatccgatgacgaagcggccgatgccgaactctccggcaacgacgatgccggcctgacctccaaaccaccttttgaattcccccctaatggaacaaccaaacactaa

SEQ ID NO: 6602 - DNA, 963 bp, Verminephrobacter eiseniae EF01-2
atgacctcccccccattccctcctgcgccggaccgcagggcacccgacgatgacgagcggcagggtgcaggtccggcctgtgtgctggtgttcaacgccagcgacccgagcggggccggcgggctgaccgcagacatcaccgccattgcctcggttggcgggcatccgattgcggtggtcaccggcgcctatgcccgtgacacggccgagatcttcgatcatttcagcttcgacgatgaggtggtggccgagcaggcgcgcacggtgctcgaagaccttgccgtgcaagccatcaaggtcggcttcgtcggcagcccggaaaacatcagcgccatcgccagaatcaccaccgactacgatgaagtcccggtgatcgcgtacatgcccaacctgtcctggtggcgcgatgaactgatcgacgagtatctgaacgccttccgggaattattgttaccacaggcttcggtgttggttggaaaccacagcacgctgtggcgctggctgctgccggactggagcggccagcgcagccccacggcgcgcgacatcgcccgggcggcggccgagatgggcgtgccctacaccctggtcaccgggattgcactgcccgagcagtttgtcgagaacatgctggcctcgccccaggtgctgctcggcggtggcaagttcgagctgttcgatgccagtttctgtggcgccggcgacacgctgtcggccgcgctgaccgccctggtggcctgcggcaacgacctgggcgaagccaccggcgaagcgctgggctacctcgaccggtgcctggacgccggctttcgccccggaatggggcatatccttcccgaccgcatgttctgggccgcgcccggcgccgacgatgcccgggacgccgaagaagacaatcccaccattgacgatgcacaggccctggaaggctttgtgatgccaccccatgacaccaaacactga

SEQ ID NO: 6603 - DNA, 960 bp, Methylibium petroleiphilum PM1
atgaacacgatcgcgcccagcgctaccgaacccaccgagcccgctgcgagcgacgcgccgccggcgtgcgtgatgagcttcaacgccagcgacccgagtggtgccggcgggctggccggcgacatctccaccatcgccgcgatgggcgcacacgccctgcccgttgtcaccgccatcgtgatgcgcgataccgccgaggtcttcgaatcgcacgagatcgaggccgacaccatcgtcgagcaggcccgcagcatcctcgaggacgtgaccatctcggcgtggaaggtcggctttctcggcagcgccgagggcgtggccggcgtggccgaagtgctgagcgactaccccgacgtgccgctggtcgcctacctgaccagcgtgtcctggctcgaagaagacgaccagcaggcctaccaggacgcctaccgcgagctgatcctgccggccaccgaggtcctggtcggcaaccagcagaccctggtcgacttcctgttgcccgaatgggaggccgaacggccgccctcggcccgcgagctggcggtcgccgcgggcgagctcggcgcccgctacgtgctggtgaccggcatcgccctgcccgccagccgcggggccgaggcccaggtcgacaatgtgctggcgtcgccgcaaggcgcgatcaccggggagaagttcgagcgcttcgacgccaccttcctcggagccggcgaaaccctggccgccgcactggcctcgctgctggcaagcggccaggatctccacctcgcggtctcggaggcgctcagcttcctcgaccaggcgctggacgccgggttccgccccggcatgggcaatgtggtccccgatcgcttcttctgggcgctgccggaagccgagcccggcgccgaggaagagggactgatgggcgagcctgccaccgacgaactgccgtccgccgagcgcgggccgcgccgcatccactga

SEQ ID NO: 6604 - DNA, 957 bp, Delftia acidovorans SPH-1
atggcattgaacccctccaactcccccagtcccgacaccgaattggtggacgaaaccgctcccgtatgcgtgctggtcttcaacgccagcgaccccagcggagcaggtggcctgtcggccgacatcgccaccatcgcctcggtcggcggtcatccgctgcccgtggtcacgggtgcctacgcacgcgattcggccaagatcttcgagcattttccctttgacgacgaggccgtggccgagcaggcgcgcgccgtgctggaggacatacccgtgtccgccatcaaggtcggcttcgtgggcagcccgggcaacctggcggcgatcgccgagatagcttccgactatcccgacatccccatcgtctgctacatgccggacctgtcgtggtgggaggaagacccgctcgaccagtacatggacgcgctcaaggagcttgtgctgccgcaaacctcggtgttggttggaagccacagtacgctgtgccgctggctgctgcccgactggagcaacagccgcagccccacggcgcgcgacatcgccatggcggccgaggccctggaagtgccctacgtgctggtcaccggcatccccctgcccgaccagttcgtggacaacgtgctggccacggcgcagtccgtgctgggcaacagcaagtacgagatgttcgacgccacgttcaccggctcgggcgacaccctgtcggccgcgctggcggccctggtggccagcggcaacgacctggggctggccacgcaggaggcgctggagtacctggaccgcagcctggacagcggctttcgccccggcatgggccacttcatcccggaccgcatgttctgggctcagcccgaacccgaggacgaagacgccgaggccgccgagccgctcaccgagctcgacgccgacacccaggccatcgaaggcttcgtgatgccgccccatgacaccaagcattga

SEQ ID NO: 6605 - DNA, 933 bp, Leptothrix cholodnii SP 6
atgaacccaaccgccaccgacacccccaccgagtcacccgaagacctcgcgcccggccccgtctgcgtgatgtgcttcaacgccagtgacaccaccggtgccggcggcgtgcctggcgacgtggccacggtcgccgccatgggcggccacgccgtgccggtgatcaccacgatcgtgatgcgcgacaccgccgaggtgttcgaccagagcccgatcgaccccgacacggtggtcgagcaggcccgcagcgtgctcgaagacctcaccatctcggcctggaaggtcggcttcctcggcaccgccgaaaccgtcggcgcggtcgccgaggtgctgaccgactaccccgacgtgccgctggtcacctatgtgcccaacctgtcgtggatcgacgacgaggacgccgcacagtcctaccacgatgccctgcgcgagctggtcctgccgcagaccgaagtgctggtcggcacgcagaagacgctgaccgatttcctgctgcccgagtgggacgccgagcgcccgccgtcggcgcgcgaactggcggtggcggcggccgaacacggcaccagctacgtgctcgtcaccggcgtgcagctgcccaacaacttcatcgacaacgtgctggcctcgccgcaaggcgccatcaccggcgaaaagtacgagcgcttcgacgccgccttcgtgggcgcgggcgacaccctgtcggccgcgctggccacgctgctggcgtccggccaggagctgcacatcgccgtctccgaaggcctggccttcctcgaccaggcgctcgacgcgggcttccggcccggcatgggcaacgtcatccccgaccgtttcttctgggccgtgccgcccgatgaagaagacgaagaagcgctcgatggcgaagacacccccgacgccaacagcccgccgacctcccgcaacatccactga

SEQ ID NO: 6606 - DNA, 945 bp, Diaphorobacter TPSY uid29975
atgcaatcgaataccccttcagcacccgacagcccaagcttgacggcggatgacagcgaatccaccgcccccaccatctgcgtgatggttttcaatgcaaacgaccccagcggcgcgggaggattggcggccgatatttcggcggtgtcctcggtcggggggcatgtcgcgccagtggtgaccgggacctatgtgcgtgacagcgccgagatattcgaccattacgccttcgaagacgagacggtcgccgagcaggcccgtgccgtgctggaggacatgccgctgcacgcgatcaaggtcggcttcgtggggagccccgagaacctgagcgccatctccgagatcgccgccgactatgcggacgtgcccgtcatcgccttcatgccggacctgtcgtggtggcaggacgacctcatcgaccagtaccacgacgccttccgcgagctgttgctgccgcagacatcggtgttggttggaaaccacagcaccctgtggcgctggctgctgccggactggggcagtgagcgcccaccctcggcacgcgacttggccatggcagtcgcggagataggcgtgccctatctattggtgaccggcattcccgcggcggagcggcacatcgacaatgtgctcgcctcaccgcagacggtgctgggcagcgggcgcttcgaacgctttgaagtgacttttatcggagcgggcgacaccctgtcggccaccctggcggcgctcattgccaccggcagcgacctgggcgaggccacgagcgaagcgctcacttacctggacggctgcctgcagcacggattccgccccggcatgggccatgtgctgcccgaccgcatgttctgggcgcagcccgacgacgaggacaccgacgacgacgtatctccctccgcggtcgtggagggcttcgatttgccaccccatgacacacaacactga

SEQ ID NO: 6607 - DNA, 966 bp, Variovorax paradoxus S110
atgaccatctacttacatccagcagaccacgcccgcaaaccgggcaatcttaacgacccctcgccggacgccgaagaggtggccgagcgcgacctgaatccgccctgcgtgctggtcttcaacgccagcgatccgagcggcgcgggcggcctgggcgcggacgcactggccatggcctcggtcggcgcgcacatgctgccggtggtgacaggcgcctacgcccgcgacacagccgagatcttcgaccatttcgccttcgaggaagaggccatcgccgagcaggcgcgcgccatcctcgaggacgtggaggtccagctcatcaaggtgggcttcgtcggaacgcccgacgcgctgagcaccatcgccgagaccgcctccgactaccccgaggtgccgctggtggcctacatgcccaacctttcctggtgggacgaggacctcatcgagggctatctggacgccttccgcgagctgctgctgccccaggccacagtgttggttggaaaccacagtacgctgtggcgatggctgctgcccgactggagcggcgagcgtccgcccggcgcgcgcgacatcgccaaggccgccggcgaattcggcgtgccctacacgctggtgaccggcatggtgctgcccgaccagttcatcgacaacgtgctggcctcgccgcagtcggtgctcgccagcgagaaatacgagcggctcgaagcggtctttgccggcgcgggcgacacgctgtcggccgcgctggccgccctgctcgcgagcggcaccgacttggtggccgccaccaccgaggccctggcctacatggaccgctgcctcgacgcgggctttcggcccggcatgggccacgtgctgccggaccgcctgttctgggccgagcccgaagacgacgatgacgacgatgaagaccccgacgcgccgcaagactttgccctgccccctcacgacacccgacactga

SEQ ID NO: 6608 - DNA, 369 bp, Ralstonia solanacearum
atggcaatcaaaaagattctggtggttgatgactcccccaccgaagcactgttcctgtcggaaatcctgagcaagaacggtttcaaggtgtcggtcgcggccgacagcgaccaggccatggccaagctggaaggcgagcctttcgacctggtcctgatggacgtggtgatgcccggccagaacggctaccaggccacccgcgcgatcaagaaggacgatcgcttcaaggacatcccggtgatcatctgcaccaccaagggcctggagaccgaccgcgtgtggggcatgcgccagggcgcgtcggactacatcgtcaagccggtcaaggcagaagagctgctcgaaaagatcgccaagctgccgcagtaa

SEQ ID NO: 6609 - DNA, 366 bp, Pseudomonas putida KT2440
atggcccgagttctgattgtcgacgactcgccgacagagatgtacagattgaccgaatggctggaaaagcacggctaccaggtgctcaaggccagcaacggtgccgacggcgtggccctggcccggcaggacaagcccgacgcggtgctgatggacatcgtcatgcctggcatgaacggcttccaggccacccgccagctcagcaaggacccggacaccagcgctattccagtgatcgtggtaaccaccaaggaccaggaaaccgaccgtatctgggccacgcgccagggtgcccgtgacttcctgaccaaaccggtggaagaggaggcgctgatcgccaagctcaaagaagtgctgggggcttga

SEQ ID NO: 6610 - DNA, 366 bp, Pseudomonas syringae tomato DC3000
atggctcgaatactgatcgtcgatgactcgccgactgaaatgtacaaactcacgggcatgctggaaaagcacggccatgaagtgctcaaggccgaaaacggcgctgatggcgtggctctggcccgtcaggaaaagcccgacgccgtattgatggacatcgtcatgccggggctcaacggttttcaggccacgcgccagctgactaaggacgccgacaccagcaacattccggtgatcatgatcaccaccaaggatcaggaaaccgacaaggtctggggcaaacgccagggcgcgcgggattacctgaccaagccggtagatgaagaaaccctgatgaaaaccctgaacgcggtgctggccggctga

SEQ ID NO: 6611 - DNA, 366 bp, Pseudomonas syringae pv B728a
atggctcgaatattgatcgtcgatgactcgccgactgaaatgtacaaactcaccggcatgctggaaaagcacggtcatgaagtgctcaaggccgaaaacggcgctgatggcgtggccctggcccgtcaggaaaagcccgatgccgtgctgatggacatcgtcatgccggggctcaacggctttcaggccacacgccagctgaccaaggatcctgacaccaccaatattccggtgatcatgatcaccaccaaggatcaggataccgacaaggtctggggcaaacgccagggcgcgcgggattacctgaccaagccggtggacgaagaaaccctgatgaaaaccctgaatgcggtgctggccggctga

SEQ ID NO: 6612 - DNA, 363 bp, Psychrobacter arcticum 273-4
atgattactgtattagtcattgaggattcattatcagagatggcgaaatttcgtgacatgctttctaaaaataactatcaagtattggaagcaaccaatggtaaacaaggttgccagatggccattgctcatctgccagacgtcattttgatggatgtggtcatgcctgaaatgaatggttttcaggcaactcgtaaaattactcgtgacgaggtaacagcacatattcctatcattatgatcagtactaaaaatcaagaaaccgatcgtgtatggggcaagcgtcaaggcgcaaaagagtatcttaccaagcctgttaatgaaagcgatctggtccagacaatttgtaaagtaatggagtag

SEQ ID NO: 6613 - DNA, 366 bp, Dechloromonas aromatica RCB
atgcccgtcaagaatattctcgtcgttgatgattcacccaccgaacggttttttacggttgatgtgctgaccaaggccggttatcaggtttcgaccgctgaaactggcgaagagggtattgccaaggccaaggccaccaagccggacttgatcctgatggatgtcgtgatgcccggactgaatggctatcaggcgacgcgtacgctgactcgcgatgaagaaaccaagggtatcccaatcatcgtctgtacctcaaaagggcaagagaccgacaagatctggggtttgcgccaaggggccatcgattatctggtcaagcccttgaatccggaagagctgttgcaacgtatcgccgcgctgccatag

SEQ ID NO: 6614 - DNA, 372 bp, Ralstonia eutropha JMP134
atgacaaccatcaacaagatcctcatcgtcgatgactcgccgacggaagcgctgttcatgtccgacctgctcggcaagcagggcttcaaggtctcggtcgcgggcaacagtgaccaggccttcgcgcgcctcgaggccgaggccttcgacctgatcctgatggacgtggtcatgcctggccagaacggctaccaggccacgcgcgccatcaagcgcgacgatcgcttcaaggacatccccgtgatcatgtgcaccagcaagggcctggacacggaccgcatctggggcatgcgccagggtgcgtcggactacatcgtcaagccagtcgacagcaaggaattgctgaccaagatcgctgcgctgtctcactga

SEQ ID NO: 6615 - DNA, 366 bp, Thiobacillus denitrificans ATCC 25259
atggcgatcagccgaattctggtagtggacgattctccgaccgagcgttttttcctgtccgagcttctggtcaagaacggctatctggtcagcatggccgaaagcggcgaggaggccgtggcgcaggcgaagcagacgctccccgacctcatcgtcatggacgtcgtgatgccgggcatgaacggctaccaggcgacgcgcatgatctccaaggaagaagcgaccaagcacatcccggtcatcatgtgcacgaccaagggccaggaaaccgacaaggtgtggggcatgcgccagggcgccaaggcctatctggtgaagcccgtgaaacccgaagacttgctctcgcagatcaaggccctgggctga

SEQ ID NO: 6616 - DNA, 366 bp, Nitrosococcus oceani ATCC 19707
atgacacatatcttagtagttgatgattcctcaacagaaagccatgcatttaggataatgctagaaaaaaaagggtttaccgtttcctttgctaataatggcttagaaggcctgaccaaagccaaagccttaaagcctgatttgatattaatggatgttgtaatgccacaggttaacggtttccaagctacaaggaagctaaagcgtgatccagaaactgctggaatacccgtaataattatatcagcaaaaaatcaggaaacggatcgagtttggggtctacgccaaggggctaagggttatttatctaaaccagtcagcaaggaagaactatttaataaaattaatatgctaataaacccctaa

SEQ ID NO: 6617 - DNA, 366 bp, Rhodoferax ferrireducens T118
atggctatccataaagttctgatcgtggacgactcaaaaaccgagttgatgttcatgaccaatttgctgcaaaaaaacggtatgtcggtgcgcacggcagagggcgctgatgaagcgctgcgccgactcgcagaagaaaaacccgatctgatcctcatggacgtggtgatgccgggccaaaacggttttcaactgacgcggtccatcaatcgtacgcccgagtattcggatatccccatcattatgtgcaccagtaaaagtctggagacagaccgcgtatggggtatgcgccaaggcgcgcgcgactacatcaccaaaccggttgatgcagccgagttgttggtcaagatcaaggcactgggctga

SEQ ID NO: 6618 - DNA, 363 bp, Saccharophagus degradans 2-40
atggccaaagtactaattgttgatgattcaccaacagaaacttataagttaacgactattttggaaaaaaatggccacactgtaattacagccggcaacggcgaagagggtgtggttactgccaaggcagaaattcccgatttagtgttaatggatatcgtaatgccgggcctcaacggctttcaggcagctcgtcagttgagtaaggcgccagaaacggcccatattcctgtcattatcgtcactaccaaagatcaagaaactgatcgcgtttggggaatgcgtcaaggggcgaaagcttacttaaccaagccaatcgatgaaaaagatctattgagtaccatctcaaaagtaggtgtgtaa

SEQ ID NO: 6619 - DNA, 366 bp, Methylobacillus flagellatus KT
atgacgatcaagaaaatcctcgtggtggatgattcggcgactgaccgtttgtacttgagcgagctcctgcagaaagctggctttgaagtgagtacggcagaagatggccaggactgcctggagaaggtcagcgcatctatgccggacttggtactgatggatgtggtcatgccgcgcctcaatggtttccaggccacgcggtccttatccaggaatcccgacactgcgcatatccccgttattgtctgcacaggcaaggagcaggccaccgaccggatgtgggcgttgcggcaaggggccagggattgtgtcatcaagcctgtggatgcggacgagcttttgtccaagattgcggagatttgctga

SEQ ID NO: 6620 - DNA, 366 bp, Polaromonas JS666
atggcgattaagaaaatattggtagttgatgactccaagactgaattgatgtttctgaccgatctgctggtcaagaatggcttcactgtcaaaaccgcagaaaacgcggaagacgcctttcgccgcctggccgaggacaagccggagctgattctgatggatgtggtgatgccggggcaaaacggcttccagctgacgcgcgccattacccgtgaccccctttattcggacatccccatcatgatgtgcaccagtaaaaatcaggaaaccgatcgggtgtggggcatgcgtcagggggctcgcgactacatcaccaagcctgtggatgctgatgagttgatggccaaaatcaaggcccttggctga

SEQ ID NO: 6621 - DNA, 363 bp, Psychrobacter cryohalolentis K5
atgactactgtattagtcattgacgattcaccatctgagatggcgaaatttcgcgacatgctttctaaaaataactatcaagtattggaagcgaccaatggtgaacaaggctgccagatggccattgctcatctaccagacgtcattttgatggatgtggtcatgcctgaaatgaatggttttcaggcaactcgtaaaatcactcgtgacaaggcaacagcacatattcctatcatcatgatcagtaccaaaaatcaagaaaccgatcgtgtatggggcaagcgtcaaggcgcaaaagagtatcttaccaagcctattgatgaaagcggtctggtccagatcattcgtaaagtaatggagtag

SEQ ID NO: 6622 - DNA, 369 bp, Cupriavidus metallidurans CH34 uid250
atgaccatcagcaaaatccttatcgtcgacgattcgcccaccgaagccctgttcatgtccgacctgctcggcaagaagggcttcaaggtttccgtggccggcaacagcgaccaggccatggcccggctcgaggcggacgctttcgacctgatcctgatggacgtggtgatgccgggccagaacggctaccaggccacgcgcgcgatcaagcgcgacgaccgcttcaaggacatcccagtgatcatgtgcaccagcaagggcctggaaaccgaccggatctggggcatgcgccagggcgcgtcggactacgtcgtcaagccggtggacagcgaagaactgctgtcgaagatcgccgcgctggcgaactga

SEQ ID NO: 6623 - DNA, 366 bp, Alkalilimnicola ehrlichei MLHE-1
atggcgcgcattctggttatcgacgattcacccaccgatctccacgccatccgctccatcctggagggggaggggcaccagctgattgaggccggtgacggggagcaggggctggaacaggcgcgcagcgcccatcccgatcttatcctcatggacatcgtcatgcccggcatgaacggcttccaggccacccggcggctcaaccgcgacgccgagaccgcctcgatcccggtgatcatggtcagcagcaaggaccaggccaccgaccggatctgggccaagcgccagggcgcggtggattacatcgccaagcccgtggagcgcgatgaactgctccagaaggtacgcgcggtgttgggcggctga

SEQ ID NO: 6624 - DNA, 366 bp, Pseudomonas aeruginosa UCBPP-PA14
atggctcgtattttgattgttgatgactctccgaccgagatgtacaagctgaccgccatgctggaaaagcatggtcaccaggtactcaaggccgagaacggcggcgacggcgtcgccctggcccgccaggaaaagcccgacgtggtcctgatggacatcgtcatgcccggcctcaacggcttccaggcgacccgtcagttgaccaaggacgccgagaccagcgccatcccggtgatcatcgtcaccaccaaggaccaggagaccgacaaggtctggggcaagcgccagggcgcgcgcgactacctgaccaagccggtggacgaagagaccctgctgaaaaccatcaatgcggtgctggcgggctga

SEQ ID NO: 6625 - DNA, 366 bp, Acidovorax avenae citrulli AAC00-1
atgcccatccagaaagttctggttgttgacgactcgaagaccgagctgatgttcctgaccgacctgctgcagaagaaaggcatgcaggtgcgcaccgccgagaacgccgacgaggccttccgccgcctggccgaggaaaagcccgacctgatcctgatggacgtggtcatgcccggccagaacggcttccagctcacgcgcgccatcagccgcgacccccagtacgccgacgtgcccatcatcatgtgcacgagcaagaaccaggagaccgaccgggtgtggggcatgcgccagggtgcgcgcgggtatatcaccaagccggtggatcccgcggagctgcaggccaagatcgacgcgctgaactga

SEQ ID NO: 6626 - DNA, 366 bp, Acidovorax sp. JS42
atgccgattcagaaagttttggtcgtggacgactcgaagaccgagttgatgtttctgaccgacttgctgcagaaaaagggcatgcaagtgcgtaccgccgagaatgccgaagaggcatttcgccgtctggccgaggaaaagccggacctgatcctgatggacgtggtcatgcccggccaaaacggtttccaactgacccgtgccattacccgcgatccgcagtatgcggatgtgcccatcatcatgtgcacgagcaagaaccaggaaaccgatcgcgtgtggggcatgcgccagggcgcgcgcggctacatcaccaagccagtcgatcctgcagaactgcaggccaagatcgacgcgctgaactga

SEQ ID NO: 6627 - DNA, 366 bp, Polaromonas naphthalenivorans CJ2
atgtcaatcaaaaaagtactggtcgtggatgactcgaagaccgagttgatgttcctgaccgatttgctggtgaaaaatggctttagcgtcaagacggcagaaaatgccgaagatgcttttcgccgactggctgaagaaaagcccgagttgatcctcatggatgtggtcatgccggggcaaaacgggtttcagttgacccgcgccatcgcgcgtgatccgctgtatgcggatattcccatcatgatgtgcaccagtaaaaaccaggaaaccgaccgggtttggggcatgcggcagggggcacgcgactacatcaccaaacccgtcaatgctggcgagttgatggccaaaatcaaggctctttcctga

SEQ ID NO: 6628 - DNA, 366 bp, Verminephrobacter eiseniae EF01-2
atgcccatccaaaaagtactggtcgtcgacgattcgaagaccgagttgatgttcctgaccgatctgctgcagaaaaaaggcatacaggtgcgcactgcagaaaacgccgaagaagcctttcggcgcctggccgaagaaaagccggacctgattttgatggacgtggtgatgccgggccagaatggctttcagctcacgcgcgccattacccgggatccgcagtatgccgatgtgccgatcatcatgtgcaccagcaagaatcaggagacggaccgggtctggggtatgcgtcagggcgcgcgtggctacatcaccaagccggtcgacccggccgagttgcaagccaagatcgacgccttgggctga

SEQ ID NO: 6629 - DNA, 366 bp, Methylibium petroleiphilum PM1
atgacgatcgcgaagatcctgctcgtcgacgattccaagaccgaactgcatttcctgtccgaactgctcgtcaagcgcggctatcaggtgcgcaccgccgagaacggcgaggaggcaatgcgtcggctcggcgaggagaagcccgacctcatcctgatggatgtcgtgatgccggggcagaacgggtttcagctcacccgagccatcacgcgggacgtgcgcttcaccgatgtcccggtgatcatgtgcaccagcaagaatcaggagaccgacaaggtctggggcatgcggcagggcgcacgcgactacgtggtcaagccggtcgacgccgacgagctgatcgccaagatccgcgcgttcgactga

SEQ ID NO: 6630 - DNA, 363 bp, Marinobacter aquaeolei VT8
atggcccgcattctgattgttgacgactcgccaactgaagttaagaagatttccaccattctggaaaaacacaagcacgaagtgctgaccgcagataatggcgccgatggtgtggccaaggcccgcgcggaaactccggatctggtgctgatggatgttgtcatgcccggcctgaacggctttcaggcgacccgccagctgacccgtgcgccggaaaccgcttccatcccggttgtgatcgtaaccaccaaggatcaggaaactgaccgggtgtggggaacccgccagggtgccaagggttatctggtcaagccagttaacgaagacgacctgatcaaaacaatcaacagcctgattgcctga

SEQ ID NO: 6631 - DNA, 366 bp, Pseudomonas mendocina ymp
atggctcgaattctgattgttgatgactccccgaccgagatgtacaagctgaccgccatgctggaaaaacatgggcatcaggtactcaaggcggaaaacggcgctgacggcgtggctctggcccgccaggaaaagcccgacgcggtgctgatggacatcgtcatgcccggcctcaacggctttcaggcgacgcgtcagctgaccaaggacgccgagaccagccacattccggtgatcatcgtcaccaccaaggatcaggaaaccgacaaggtctggggtaagcgccaaggcgccaaggactacctgaccaagccgatcgacgaagataccttgctgaagaccctcaatgcggtactggccggctga

SEQ ID NO: 6632 - DNA, 366 bp, Pseudomonas putida F1
atggcccgagttctgattgtcgacgactcgccgacagagatgtacagattgaccgaatggctggaaaagcacggctaccaggtgctcaaggccagcaacggtgccgacggcgtggccctggcccggcaggacaagcccgacgcggtgctgatggacatcgtcatgcctggcatgaacggtttccaggccacccgccagctcagcaaggacccggacaccagcgctattccagtgatcgtggtaaccaccaaggaccaggaaaccgaccgtatctgggccacgcgccagggtgcccgtgacttcctgaccaaaccggtggaagaggaggcgctgatcgccaagctcaaagaagtgctgggggcttga

SEQ ID NO: 6633 - DNA, 363 bp, Psychrobacter PRwf-1
atgcacaaggttttggtggtagaagactcacaatctgagatggctcgttttcgggagttattgataaaaaataactacgaagtgatagaagcgtctgatggtcaacaaggggttgagatggcgcaaatgcacttacccgatgccattttaatggatattgttatgcctgaaatgaacggctttcaggccacacgtaagattactcgcaatgaggctacaggtcatattcctgtggtgatgatcagcaccaaaaaccaagaaaccgataggatatggggcaaaagacaaggcgctaaggcttatctaactaagccagttaatgagaccgaactgctgactaccatcgactcggtcatagggtag

SEQ ID NO: 6634 - DNA, 366 bp, Pseudomonas aeruginosa PA7
atggctcgtattttgattgttgatgactctccgaccgagatgtacaagctgaccgccatgctggaaaagcatggccaccaggtactcaaggccgagaacggcggcgacggcgtcgccctggcgcgccaggaaaagcccgacgtggtcctgatggatatcgtcatgcccggcctcaacgggttccaggcgacccgccagctgaccaaggacgccgagaccagcgccatcccggtgatcatcgtcaccaccaaggaccaggagaccgacaaggtctggggcaagcgccagggcgcgcgcgactacctgaccaagccggtggacgaagagacgctgctgaaaaccatcaatgcggtgctggcgggctga

SEQ ID NO: 6635 - DNA, 366 bp, Delftia acidovorans SPH-1
atgcccatccgcaaagtcctggtcgtggacgattccaagaccgaactgatgtttctgtccgacatgctgcaaaagcagggactgcaggtacgtacggccgagaacggcgaggaagccctgcgcagcctggccgaagagcggcccgacctgatcctgatggacgtggtcatgcccggccagaacggctttcagctcacgcgcgccatcacgcgcgacccgctgtacgcggacctgcccatcatcatgtgcaccagcaagaaccaggaaaccgaccgggtctggggcatgcgccagggcgcgcgtgactacatcacgaagccggtggatgcaggcgagctgcaggccaagatcgcggcgctgaactga

SEQ ID NO: 6636 - DNA, 366 bp, Pseudomonas putida GB 1
atggcccgagttctgattgtcgacgactcgccgacagagatgtacagattgaccgaatggctggagaagcacggctaccaggtgctcaaggccagcaacggtgccgatggcgtggccctggcccggcaagacaagcccgacgctgtgctgatggacatcgtcatgcctggcatgaacggtttccaggccactcgccagctcagcaaggacccagagaccagcgccatcccggtaatcgtggtgaccaccaaggaccaggaaaccgaccgcatctgggccacgcgccagggtgcacgtgacttcctgaccaagccggtggaagaggacgcgctgatcgccaagctcaaagaagtgctgggggcttga

SEQ ID NO: 6637 - DNA, 366 bp, Pseudomonas putida W619
atggcccgagttctgattgtcgacgattcgccgacagagatgtacagattgaccgagtggctcgaaaagcatggccaccaagtgctcaaggccaacaacggcgctgacgctgtggccctggcccgccaggaaaagcccgacgcggtgctgatggacatcgtcatgcccggcatgaacggcttccaggccacccggcaattgagcaaggacccggaaaccagcgcaattcctgtgctcatcgttaccaccaaggaccaggaaaccgaccgtatctgggcgcagcgccagggtgcgcgcggcttcgtcaccaagccggtggaagagcacgccctgatcgcaaagctcaacgaagtgctgggcgcttga

SEQ ID NO: 6638 - DNA, 366 bp, Leptothrix cholodnii SP 6
atggcgatccacaacatcctgctggtggatgactccaagaccgagctgtactttctgtcggatctgctgagccgccagggtttcaaggtgcgcaccgccgaaaacggcgacgaggcgctgcgccgcatcgccgaggaaaaacccgacctgatcctgatggacgtggtgatgccgggcctgaacggcttccagctcacccgcacgatcacgcgcgatccgcaatatgccgacgtgccggtgatcatgtgcaccagcaagaaccaggagaccgacaaggtctggggcatgcgccagggggcgcgtgactacgtcgtcaagcccgtcaatcccgacgagctgatgcagaagatccgagccttcggctga

SEQ ID NO: 6639 - DNA, 363 bp, Xanthomonas oryzae PXO99A
atggctcgaattgtattgatcgaggactcgcccaccgacagcgcagtcttcagtcaatggctggaaaaagcaggccatacggtcgtcgccaccgataacgcagaagagggacttgagctggttcgcagccaggtgcccgatcttgtgttgatggatgtggtgttgcccggcatgagcggcttccaggcaacgcgtgcacttgcacgcgaccaggctaccaaggacatccccgtgctgctggtcagcaccaagggcatggaaaccgacagggcctggggtttgcgacaaggtgccagcgactacatcgtcaagccgccgcgcgaagacgatttgatcgcgcgcatcagacaactggtgcgttga

SEQ ID NO: 6640 - DNA, 369 bp, Ralstonia pickettii 12J
atggcaatcaagaaagtgttggtggtcgatgattctccgaccgaagcgctgcacctgtcggagatcctcggcaagaacggtttcaaagtgacggtcgctgccgatagcgagcaggccatgaccaagctcgaagccgaaaccttcgacctgatcctgatggacgtggtgatgccgggccagaacggctaccaggcgacccgcgccatcaagaaggacgagcgcttccagggcatccccgtgatcatgtgcacgaccaagggcctggagaccgaccgcgtgtggggcatgcgccagggcgcatcggactacatcgtcaagccggtcaaggccgaagagctgctcgagaagatcgccaagctggcgcagtga

SEQ ID NO: 6641 - DNA, 363 bp, Stenotrophomonas maltophilia R551 3
atggctcgtatcgttctgatcgaggattcaccgaccgaccgcgcggtgttcacccagtggctgcgccgtgccggccacgaggtgctggaagcggacaacgccgaggatggcctgcagctggtccgcgaccaatcgccgcagctggtgctgatggacgtggtgctgcccggcatgagcggtttccaggcgacccgggcgatggcccgcgacgccgcgatcaagcacatcccggtgatcatcgtcagcaccaaggcgatggaaaccgacaaggcctggggcctgcgccagggcgcggccgattacatcgtcaagccgccgcgcgaggatgaactgatcgcgcggatcaacgaactggtggcctga

SEQ ID NO: 6642 - DNA, 366 bp, Thauera sp. MZ1T
atgccgatccgcaagattctcgtggtcgacgactctcccgtcgaacgcctcgccctccaggaggtgctgggccgcaacggctaccaggtgctgaccgccgagaacggcgagcaggccatcgcacgcagccgcagcgaccaccccgacctcatcctgatggacgtggtgatgccgggcatgaacggctaccaggccacgcgcacgatctcgcgcgatgacgagacgcgcgacatcccgatcatcatgtgcaccagcaagggccaggagaccgacaagatctggggcatgcgtcagggcgcgctcgactacctggtcaagccggtcgaccacgacgaactgctcgcccgcatccgggcgatgggctga

SEQ ID NO: 6643 - DNA, 363 bp, Thioalkalivibrio HL EbGR7
atgacgcagatcctggtagttgacgattcgcccaccgagattcacgtactcaagaccatcctggagaagaacggctacagcgtgatgaccgcctccagcggtgaagagggtgtcgccatggccaaacagcacaagcctgcgctggtgctgatggacgtggtgatgcctggcctcaatggcttccaggccacccgccagctggccaacgatgccgccaccagcagcatcccggtgatcgtggtcaccaccaaggaccaggagaccgacaaggtctgggccatgcgccggggtgccaaggactacatcgtcaagccggtcaaggagcgcgatcttctcgagcgcgtcaaggccctggtcgcctga

SEQ ID NO: 6644 - DNA, 366 bp, Diaphorobacter TPSY uid29975
atgccgattcagaaagttttggtcgtggacgactcgaagacagagttgatgtttctgaccgacttgctgcagaaaaagggcatgcaagtgcgtaccgccgagaatgccgaagaggcatttcgccgtctggccgaggaaaagccggacctgatcctgatggacgtggtcatgcccggccaaaacggtttccaactgacccgtgccattacccgcgatccgcagtatgcggatgtgcccatcatcatgtgcacgagcaagaaccaggaaaccgatcgcgtgtggggcatgcgccagggcgcgcgcggctacatcaccaagccagtcgatcctgcagaactgcaggccaagatcgacgcgctgaactga

SEQ ID NO: 6645 - DNA, 366 bp, Variovorax paradoxus S110
atgcccattcgaaaaatcctcgtcgtcgacgactccaagacggaactggtgttcctctcggacctgctccagaagaacggctttgcggtcaagaccgccgaaaacgccgaagacgccatgcgccgcctcgaagaggaccagcccgacctgatcctcatggacgtcgtcatgcccggccagaacggcttccagctgacgcgcgccattgcccgcgatccgcagtacgccgccatcccgatcatcctgtgcaccagcaagaaccaggaaaccgatcgcgtctggggcatgcgccagggcgcccgcgactacatcgtgaagccggtcaacgcggccgagctgatgtccaagatcagcgcgctggcctga

SEQ ID NO: 6646 - DNA, 369 bp, Ralstonia pickettii 12D
atggcaatcaagaaagtgttggtggtcgatgattctccgaccgaagcgctgcacctgtcggagattctcggcaagaacggtttcaaggtgacggtcgctgccgatagcgagcaggccatgaccaagctcgaagccgaaaccttcgacctgatcctgatggatgtggtgatgccgggccagaacggctaccaggcaacccgcgccatcaagaaggacgagcgcttccagggcatccccgtgatcatgtgcacgaccaagggcctggagaccgaccgcgtgtggggcatgcgccagggcgcatcggactacatcgtcaagccggtgaaggccgaagagctgctcgagaagatcgccaagctggcgcagtga

SEQ ID NO: 6647 - DNA, 456 bp, Jannaschia CCS1
atggccgatactgagtattcattcgcggaaattgccaccggcggggtcgtgtttgccgccgccatcggctttttcgactatgcgtcgggatctggcgccgcgacgtcggcggagcgctacgaattgcaggccacgttccaatccgccgaagggatcggcatcggcacggaggtgcgtctgggtggggtgcagatcggcaccgtgaccgggatggcgctgaaccctgaaactttcctggcggagacgacgttttccgtgtccaacgccattgccctgcccgatgacaccgcgatctccatcgcatctgaaagcctgctaggtgggtcctacgtggagattattcccggcacttcaccgttcaatctggaggcgggtggcgagatcctggacacccaatcctcggtcggcctggccacgctattattacggtttgtgagcggagcggcagacaattga

SEQ ID NO: 6648 - DNA, 453 bp, Ruegeria sp. TM1040
atgacccattccacaaccgaagtgctgaccggtggccttgtgctggccgtggcagcagggtttgcgttttatgccgcacaggccgcgggcctttcgcgcggcggcgatagctacccgctgacggcgtcctttcgctctctggaaggggtgagtgtcgggaccgatgtgcgtcttgctggcgtgaagatcggaaccgtgacggatgtggcgctcaatgcggaaacctttcgcgcggacacgaccttttcggtggataaaagcatcatgatccccgacgacagcgccattgtgatcgcgtcagaggggttgcttggtggaaattttgtcgaagtgatgccgggcggttcgcccttcaaccttgaggcgggtgatgagatcgtggacacccaaggggcggtgagcctgatttctctgctggtcaaatttgtctccggcggcggtgacgaatcctga

SEQ ID NO: 6649 - DNA, 456 bp, Rhodospirillum rubrum ATCC 11170
atgcgtaacccgatcgaaacgatcatgggcgcggtggttctggtcgttgccgcctttttcctggtttttgcctataacaccgccgatctcaaggcggtgaccggctatccgatccaggcggttttcctcaaggtcggtggtttggtgacgggcagcgacgtgcggatcaacggcgtcaaggtcggcaccgtcaccggccagaccctggattccgatacctacgaggcggtggtcgatatgaccatcagcggcgatatccatattcccgaggactcgcgcgccgccatcgtcagcgatggtctgctggggggcaaatacgtgcgcctggaacccggccaatcggcgaccagactagccgccaacgcccgcctgacccatacccaggatttccagtcgatggaagaactggtgggcgagatcatcttcctcgcgacacagcccgctcccgggtcttga

SEQ ID NO: 6650 - DNA, 471 bp, Rhodobacter sphaeroides 2 4 1
atggctgaaaaccggtcagaacttctcgccggcgccgccgtgctggcagccgccatcggcttcatcgtctatgcagggcaggtggccggcatcacgcgcgacagcggctcctatccgctgaaggcgagcttccggtcggtcgacggcatctccgtcggcacggatgtgcggctcgcgggcgtgaaggtgggctcggtcacggggctcgcgctgaacccgcagacctatttcgccgacgccaccatctcggtgaagcagggcatcgagctgccgaccgattctgcgatcctcatctcgtccgaggggctgctgggcggcaactatgtcgaactggtgcccggcggtgcgctcgagacgctcgctgcgggcgaggagatcgaggatacccagggctccgtcagcctgatctcgctcctgatgaaattcgtgggctcgggcgccgaggacacggtgaaggggcccggcgaatga

SEQ ID NO: 6651 - DNA, 468 bp, Paracoccus denitrificans PD1222
atgaactccgccgccgaacgggccgagctttgggttggcgcggcggttctggccgtggcggccgggtttctcgtctggtccaccaccggcagcaggctgggcgtgtccctggcgggcggctatgagttgcgcgcggcctttcccaatgtcgacggcatcgaggtcggcaccgatgtccgggtcgccggcgtcagggtggggcgcgtgtcggccgtcgatctgaacccgcagacctaccatgccgaggcgcggctgcgcctgcccgacagcatccgcctgcccagcgacagcgcggcgctgatccagtcggacgggcttctgggcggggcctatatcgaattgcagcccggcggcgcccccgacaacctggcgcccggcgacgagatcgaggatgtgcagggtgcagtcagcctgatttcgctgatgatgaaattcgtggatgcgcaaagcacggatgacagcccatga

SEQ ID NO: 6652 - DNA, 471 bp, Rhodobacter sphaeroides ATCC 17029
atggctgaaaaccggtcagaacttctcgccggcgccgccgtgctggcagccgccatcggcttcgtcgtctatgcagggcaggtggccggcatcacgcgcgacagcggctcctatccgctgaaggcgagcttccggtcggtcgacggcatctccgtcggcaccgatgtgcggctcgcgggcgtgaaggtgggctcggtcacggggctcgcgctgaacccgcagacctatttcgccgacgccaccatctcggtgaagcagggcatcgagctgccgaccgattctgcgatcctcatctcgtccgaggggctgctgggcggcaactatgtcgagctggtgcccggcggcgcgctcgagacgctcgctgcgggcgaggagatcgaggatactcagggcgccgtcagcctgatctcgctcctgatgaaattcgtgggctcgggcgccgaggacacggtgaaggggcccggcgaatga

SEQ ID NO: 6653 - DNA, 471 bp, Rhodobacter sphaeroides ATCC 17025
atggccgagaatcgttcggaaatcctggccggagcggcggttctggcggccgccatcggctttctcgtctatgccgggcaaaccgccggcatcacgcgcgacagcggatcctacccgctgacggccagcttccgctcggccgagggaatctcggtcggcaccgacgtgcgccttgcaggcgtcaaggtcggcacggtgaccgccctcgcgctcaacccgcagaccttctttgccgacgccacgatctcggtgaagcaggggatcgagctgccgaccgactcggcgatcctgatctcgtccgaggggctcctcggcggcaactacgttgaactgatgccgggcggcgcgctggaaaacctcgctccgggcgaggagatcgaggacacccagggctcggtcagcctgatctcgcttctgatgaagttcgtcggctcgggcgccgagagcgccatccagggcgaggaaggatga

SEQ ID NO: 6654 - DNA, 501 bp, Acidiphilium cryptum JF-5
atgaagaatcgggtatcggaaatcatcgcgggcctggtcgtgatcgtcgcggccgccgtctttctcgcctatgcggcgtcgcgaacgcgcaccgtcggcggcacgggatatgacttgcgcgcgagtttcggcagcatcggtccgctcaccgtcggctctccggtcaagatcgccggcgtcacgatcggcgaggtgacccgcacctcgctcgacccgcagacctatgccgcgatcgtacagttccgcatccagccggacgtcaagattccgaaggatagcagcgcggcgatcgagagcgcgtcgctgctgggcagcgattatctttcgatctcgcccggcggttccgaaaccatgttgaagcccggccaggcaatcaccgcaacgcagtcggccatcaacatcgaatcgctgctcggcaagttcgtcttcagcgccgcaaacctggcgacctcgacagcgaaggcgaacggcggcggcacttcggcaccggccccgaaatga

SEQ ID NO: 6655 - DNA, 495 bp, Sphingomonas wittichii RW1
atgaagtcgctgttgcgtgagaatatcggcgaggcgctcgtcggactgttcgtcgtcctgttcgcggcctggttcgtctggttcgcctggggcgccaccggcggcggcgccaaggccggcgcgatccacgtcaccgcgctcttccccaacagcaccggcatcaacgtcggcagcgaggtccgcgtcgccggcatgaagatcggcaccgtcaccagccaggcgctcgatccgcagagcttccaggtcaagaccacgctcgcgctcgatcccaaggtcaagctgcccgccgacagcagcgcggcgatcacctccgagggcttcctcggcgcgaccttcgtctcgctgatcccgggcggcgacaccgtcccgctcaaggacggcgacaccatcgccgacacccagggcgcgatggacctgatgagcatggtcggccagttcatcaacaagtcgggcggcgcggccgccggcggggccgaagaggcgcccaagccgtga

SEQ ID NO: 6656 - DNA, 495 bp, Parvibaculum lavamentivorans DS-1
atgcaaagcaatctcgtcgaaacgctgatcggcacgctggtcgttgcggtggccgccgtcttcctcttttacggctacagcgcctccggcatgcgcggcagcgccggctaccatgtgaatgccgccttcagcggcatcgacgggctcgccaatggcgcggatgttcgcgtctcgggcatcaaggtgggaacggtggtgcgccagaacctcgatccggaaaccttccaggcggtcgtgacgctcgatatcgcacagaacgtgaagctgccggacgacagcagcgccaagattaccagcgaggggctcctcggcggcagctacatctcggtcacgccgggcggcagcgaggaatacctcgccgatggcggcgagatcatgttcacccagggctccgtcgacctgatgagcctgatcggccaggccgtgttctcgacgcagggcgggggagactcctccggcggcagcccggccgccgacccgatgggcggccagtaa

SEQ ID NO: 6657 - DNA, 447 bp, Dinoroseobacter shibae DFL 12
atgtcacacagtaaaaccgaagtcgtcgtcggcggcgccgttctggccgccgcggtcgggttcctccttttcgtctccaatgccacgggcttttccggcgggggcagcggctatccgctgaccgccagtttccgctccgccgacgggatcaccatcggcaccgatgtccgcctcgcgggcgtcaagatcggcaccgtcacgggcatcgcgctcaatcccgaaaccttccgcgccgacaccacgatctcggtctccgagaacatcgagatccccgatgacagcgcgatctccgtgtcctccgagggccttctgggcggcaatttcatcgaaatcctgcccggcggctctcccttcgccatggaaaccgggggcgagttcatcgacacccagggctcggtcagcctcgtgtcgctgctgatgaaattcgtcggcggggacggctcgtga

SEQ ID NO: 6658 - DNA, 264 bp, Ralstonia solanacearum
atgaagcgaatgatccccttgctgctggtcgcagcacttgcggcctgcggcccatcggaaacgcccaggcaggccaacgtgccgaccgtggaagaacttgccgccgatccggcacgcttgaaggaactgcgccagcaatgcaagaccgaccgcgcgacactcggtgacgtgttgtgcaaccgggtggccgaagctacgcgcaagcggttctacggcgatggcaagacaccctacacgccgtcagaaaccccaccgaagttctga

SEQ ID NO: 6659 - DNA, 315 bp, Burkholderia thailandensis E264
ttgaatcacttgcggcaaagaaggccgtcgtatcatttgatcccgacgcgagggaggaatagcgccgtgaaaccgatcatgctgattctgctcgttgcattgctgacggcctgcggcaaatccaagccgaccgaaacggtggattccctcgtagccaatcccgagcacttgaaggaactgcgccagcagtgcaagaaagatcgtgtcacacttggcgacgaactctgcaaccgcgtggccgaggcaacgaaccggcagttcctgggcaatggcaaagcgccgtacaccccgccgaaggatgcgccgaagttctaa

SEQ ID NO: 6660 - DNA, 279 bp, Cupriavidus metallidurans CH34 uid250
atgaagaagatcattccgttcttgctggtggctgccttgaccgcctgcggtcagtccgagacacctctgaacgccaccaattcaaaggcaaggattccgacagtagaagaactggcggctaacccagagcacctcaaagaactgcgtctgcaatgcaagaccgaccgccccaagttgggcgatacgatatgcgatcgggtcgccgaagccacgcgcaaacggttctatggcgaccgtgatactccgtacacgccaccgaaacaatcgcccaagttctga

SEQ ID NO: 6661 - DNA, 279 bp, Cupriavidus metallidurans CH34 uid250
atgaagaagatcgttccgctgttgctaggtgtcgccttgactgcctgcggccaatctgaggtgcctcagaaggccaatacgtcggaggcggatattgcaacggtggaagaactggcggccaatcccgaacggcttaaagaactgcgccagcagtgcaaaaccgaccgccccaaggtgggagacgtgctctgcaatcgagtggcggaagccacgcgcaagcgattctatggggacggcgaaacgccctatacaccgccgaaagagtcgccaaagttctga

SEQ ID NO: 6662 - DNA, 267 bp, Burkholderia ambifaria AMMD
atgatgagaaactccattccgttcctgctggccgtggcattaaccgcttgcggccaatcggaaacgcccaagcaggccgaggtgtcgaccgtggaggaactggccgccgatccggcactgctgaaggagctgcgccagcagtgcaagactgatcgcgccaggcttggcgacgtgctgtgcaatcgagttgccgaggctacgcgcaagcggttctacggcgatggaaagaccccgtatacgccgccgaaggaacagcctaagttctga

SEQ ID NO: 6663 - DNA, 264 bp, Shewanella sp. ANA-3
atgaagcagatcgtcccattattactggtcgcgacattggccggatgcggtcagtcggactcgcctcgacaggccgacgtgttgactgtggaagaactggctgctgatcccgcgcggctgaaggagttacgccagcagtgcaaaacggaacgcgctcagttgggcgatgtgctgtgcaaccgagtcgccgaggctacgaaccagcgcttctttggcgaagggggtacgccttacaccccgccggaggagtcgcccaggttctga

SEQ ID NO: 6664 - DNA, 267 bp, Acidovorax avenae citrulli AAC00-1
atgaagcgatctatccctttgttactggttgctgcactcgcggcctgcggcccgtccgagccaccgaaggagcaagccaatgtgcctaccgtcgaagaactggctgccgcccctgaacgattgaaggagctgcgccgccaatgcaagaccgagcgtccgacgatgggcgatgtgctgtgcaaccgcgtggccgaagcaacgaacaagcgcttcttcggagacggcaaggtgccttacacgctatcggagacgccgccgaagttctga

SEQ ID NO: 6665 - DNA, 243 bp, Polaromonas naphthalenivorans CJ2
atgaagatgattgctgccctgatgctcgtgctgcagctgaccgcctgcggccagtccgcacccacggagactgtcgaatcactggctgccaaccccgagcggttgaaggaactgcgcgcgcagtgcaaagctgatcgtgccaagctgggcgatgcattgtgcaacgcagtggccgaagcgacacataaacgcttcattggcaacggcacgccgtacacgcccgaaccgacaccgaagaactga

SEQ ID NO: 6666 - DNA, 264 bp, Pseudomonas aeruginosa PA7
atgaacaagatcacaccgttcttgctgaccgtagtgctggccgcttgcggccagtccgagacaccgacgtcggcagcggtgccgacggttgaggaacttgcgaccaaccttgaacggctcaaggagcttcgccaacagtgcaagctcgatcgcgccaagctgggtgacgagttgtgcaaccgcgtggctgaggccacgcgcaagcgcttctatgggaatggaaccgtgccctacacgccgcccgagacaccgccgaagttctga

SEQ ID NO: 6667 - DNA, 279 bp, Pseudomonas aeruginosa PA7
atgaaaagaatcatcccgcttttactgttcgccgcgatgactgcctgcggccagtccgaggcgcctcagaaggccaacatttcggaggcgaatattccgacggtggaggaactggccgccaaccctgaacgactcaaggaactgcgccagcagtgcaagaccgatcgccccaggctgggcgacgtgttgtgcaaccgggtcgccgaagccacacgcaagcggttctatggcgacggtgcaacgccatacaatccgccgaaggaaccaccaaaattttga

SEQ ID NO: 6668 - DNA, 219 bp, Delftia acidovorans SPH-1
gtgatattgctgatattggtcactgcactgcctgcatgcggtccttctcaaccttcggaaaccgtggatgcgctcgtagccaatcccgaacgcatcaaagagattcaacgtcaatgcaaggaagaccgcgcgaaggttggcgacgaactatgtctgcgtgctgccgaagccgccaaacggcgatttttcggtgatcggcccgagcaaaaatccaagtag

SEQ ID NO: 6669 - DNA, 267 bp, Burkholderia multivorans ATCC 17616 JGI
atgatgaagaactccattccgttcctgctggccgtggcattaaccgcctgcggtcaatcggagatgcccaagcaggccgacgtgccgaccgtggaagaactggccgccgacccggcacggttgaaggaactgcgcgagcagtgcaagacggatcgcgccaggctgggcgacgtgctgtgcaaccgagttgccgaggccacgcgcaagcggttctacggcgatggcaacaccccgtacacgccgccgaaggaaccccccaagttctga

SEQ ID NO: 6670 - DNA, 231 bp, Ralstonia pickettii 12J
atgccccgattcctgtcgctgctgatggccgctgcactgacagcctcctgtgggccatcccaaccgacggaaaccgtggacttcctcgtggcccatcctgagcgtctcaaggaagtccagcgcctgtgcaaggaagagcgcgcgaaggccggcgaagaactctgccgacgtgccgccgaggccgcgaatcgccgcttctttggtgaccggccggagcagaagtcccaataa

SEQ ID NO: 6671 - DNA, 264 bp, Thauera sp. MZ1T
atgaagaaagccattccgttcttgctggccgtggtattgaccggctgcggccagtccgaagtgccgcaaaaggcagacctgccaactgtggaggcattggcatccaaccccgagcgcctgaaagagctgcgccagcaatgcaagctggaacgcgctcgattgggcgacgagctatgcaaccgagttgccgaggccacgcgcaagcggttctatggtgacggcaaagtgccctacacaccgccggagaaccagcccaagttctga

SEQ ID NO: 6672 - DNA, 279 bp, Thioalkalivibrio HL EbGR7
atgaacaagatcatcccgttcttgctggtggtcgccatgactggctgcggccagtccgagactcctcagaaggccaaaggctcggatgcgggtgtcccgacggtggaagaactggcagccaaccccgaacgactcaaagagctgcgccagcaatgtaagaccgaccgccccaagctgggcgacgtgctgtgcaaccgcgtggcggaagctacgcgcaagcggttctatggcgacggcgaaaccccgtacacgccgccgaaagagtcgcccaagttctga

SEQ ID NO: 6673 - DNA, 228 bp, Diaphorobacter TPSY uid29975
atgagcaaggtgatgctgctgatgctggccgccacactgactgcatgtggcccttctcaaccttcggaaacggtggatgcactcgcagccaatcccgagcgcatcaaggagattcaacagctgtgcaaggaagaccgcgcgaaggtcgatgatgaactctgccgacgcgccgcagaagccgccaaacggcgtttctacggtgatcggccggagcagaaatctaggtag

SEQ ID NO: 6674 - DNA, 228 bp, Diaphorobacter TPSY uid29975
atgaacagagtgatgctgctgatgctgaccaccgcactgaccgcgtgcggcccgtctcaaccttcggaaaccgtggactaccttgtggcccaccccgaccgcatcaaggaactccagcgccaatgcaaggaggatcgcgcaaaggtcggcgatgaactctgcgtgcgcgcggccgaagccgccaatcggcgcttcttcggtgatcggccggagcagaaatccaaatag

SEQ ID NO: 6675 - DNA, 267 bp, Azotobacter vinelandii DJ
atgaagaagaccatcccattcctgctggctgctgtggtgctaacggcgtgcggccccactgacacgccagagaagacggacgtgcccagcgttgaagaactggcatccgatcccgtgcggctgaaagaactgcgccagcaatgcaagacggatcgcctaaagctgggcgacgtgctttgcaatcgagtcgccgaagccacgcgcaagcggttctatggcgacggcaatacgccctacacgccgccggagaatccgccgaagttctga

SEQ ID NO: 6676 - DNA, 264 bp, Azotobacter vinelandii DJ
atgaagaaggccattgcgttcgtgctggttgcggtgctgacaggctgcggcccgaaggatgcgccagagaagaaagacgtgccgagcgttgaagaactggcatccgatcccgcgcgcctcaaagagctgcgccaacagtgcaagacggaacgccccaggctgggcgacgtgttttgcaatcgagtcgccgaagccacgcgcaagcgattctatggcgacggcaatacgccttacacgccaccggaggaaccacccaagttctga

SEQ ID NO: 6677 - DNA, 396 bp, Clostridium perfringens SM101 uid12521
atgagaaaaacaagtttattaaatagtaacataagttcagtcatatcaaagatgggacatactgatatgttagctataggggattgtggattacctataccaaaggaaactgagagaatagacttagctttaataaaaggcgtacctggctttatagaaactttaaaagctattttagaagaattacaagtagaagaggtacttattgctaaggaaacagaaaaggtaagtccagaattatttacaaaaataaaagagattataaaagatactaaaataacttttatatcacatgaggaattaaagaaagaattaaaagattgtaaggcagttgttagaactggagaacaaactccatatgcaaatataatcttaaaatcaggggttgttttttaa

SEQ ID NO: 6678 - DNA, 420 bp, Enterobacter sp. 638
atgaagaaaggcacggtactcaattctgaaatctcatcggttatttcccgtcttgggcataccgatacgctggtggtttgcgatgcaggcttaccggttccgcacagcacaacacgtattgatatggcattaacgcagggtgttccctcgtttatgcaggtacttgatgtggtgacggcggagatgcaggttgagacagccattctcgcgacggaaattaaacaacataatccgcaactccacgaaacgttgctcggccacatagagcaactgcaacaacaccagggaaacaccatagaaattcgttacacgacgcacgaacagttcaaacaacaaaccgcagacagtcaggcggtgattcgcagcggggagtgttccccgtatgcgaatatcattctctgtgctggcgtcacgttctga

SEQ ID NO: 6679 - DNA, 420 bp, Vibrio cholerae O395
atgaaaaaaagtaccctactaaactctgaactctcttacttggtggcaacactcggccataccgatgaaatcacgatctgtgatgctgggctgccaatccctgatgaagtgacgcgtattgatctcgcgctgactcacggggtgccttcttttttggaaacagtacgggtgattttgtctgaatcgcagattgaaagtgtcatcgtggcacaggagtttgctcaagtaagcccggtgttgcatgaagccttatatcgcgagctgaaagcagaagaacagttgtgcggtaagccaattgccatccaatacatcagccatgaagcgtttaaacaacgcacgctgcaaagccgcgcggtagtgcgcaccggtgaatgtacaccttacgccaatgtgattttccaagcgggtgtcgtgttttaa

SEQ ID NO: 6680 - DNA, 420 bp, Escherichia coli HS
atgaaaaaaggcaccgttcttaattctgatatttcatcggtgatctcccgtctgggacataccgatacgctggtggtgtgtgatgctggtttacccatccccaaaagtacaacgcgtatcgatatggcattaacccagggtgtaccttcttttatgcaggtgctgggcgtcgtcacaaatgaaatgcaggtcgaggctgccattatcgcggaagagatcaaacaacataatccgcaactccacgaaacgttgctcactcaccttgagcagctgcaaaaacaccagggaaataccattgaaattcgttacaccacgcatgaacaattcaaacaacaaaccgcagaaagtcaggcggtaattcgcagcggagaatgttctccgtatgcgaatatcattctctgtgctggcgtgacgttctga

SEQ ID NO: 6681 - DNA, 420 bp, Escherichia coli E24377A
atgaaaaaaggcaccgttcttaattctgatatttcatcgatgatctcccgtctgggacataccgatacgctggtggtgtgtgatgctggtttacccatccccaaaagtacaacgcgtatcgatatggcattaacccagggtgtaccttcttttatgcaggtgctgggcgtcgtcacaaatgaaatgcaggtcgaggctgccattatcgcggaagagatcaaacaacataatccgcaactccacgaaacgttgctcactcaccttgagcagctgcaaaaacaccagggaaataccattgaaattcgttacaccacgcatgaacaattcaaacaacaaaccgcagaaagtcaggcggtaattcgcagcggagaatgttctccgtatgcgaatatcattctctgtgctggcgtgacgttctga

SEQ ID NO: 6682 - DNA, 420 bp, Serratia proteamaculans 568
atgaaaaaaggcgtgctgctgaatgctgatgtttctgccgtggtttcccgcctcggccataccgaccagatcgtcatctgtgatgcggggttgcctattccggcggcaacgcagcgtatcgatctggcgctgacccagggtgtaccgacgtttttgcaggtgctcggggtagtgacgcaggaaatgcaggtagagagcgccattctggcggaagagatagttaaacaaaatccgcagctccatcgtgcgttgttggctcaactgaccgaacttggccaacaccagggcaataccatcagcgtgagctatatcagccacagtgcgttcaaagcgcaaactgaacatagccgggcagtgatccgcagcggggaatgttcgccgtatgcgaatgtcatcctctgcgccggcgtaactttctga

SEQ ID NO: 6683 - DNA, 420 bp, Escherichia coli C ATCC 8739; identical to SEQ ID NO: 6680

SEQ ID NO: 6684 - DNA, 432 bp, Escherichia coli SMS 3 5
atggagaaaaaaatgaaaaaaggcaccgttcttaattctgatatttcatcggtgatctcccgtctgggacataccgatacgctggtggtgtgtgatgctggtttacccatccccaaaagtacaacgcgtatcgatatggcattaacccagggggtaccttcttttatgcaggtgctgggcgtcgtcacaaatgaaatgcaggtcgaagctgccattatcgcggaagagatcaaacaacataatccgcaactccacgaaacgttgctcactcaccttgagcagctgcaaaaacaccagggaaataccattgaaattcgttacaccacgcatgaacaattcaaacaacaaaccgcagaaagtcaggcggtaattcgcagcggagaatgttctccgtatgcgaatatcattctctgtgctggcgtgacgttctga

SEQ ID NO: 6685 - DNA, 408 bp, Natranaerobius thermophilus JW NM WN LF
atgaaaaaaacaactttgctgaatagcgaaatttcccgagttacttctcaaatgggccatactgacggattgactatttccgatgctggacctcccatcccccaagaatcagaacggatagacctggcccttaaggaaggggtaccagcttttatggaaacactagaaacggtactttccgagttacaggttgaagcagtggtactgactactgaaacgagagaagtgagcccacaaacttatcataaaattgtggacttattaaaacagtacaatcctgatattcaaataacagaaattgaccatgaaagctttaaaaaagaggtttcaaacacaaaagcagttgtcagaaccggtgaatgtacacctttttctaatattattttaaaatccggagtggtgttttaa

SEQ ID NO: 6686 - DNA, 420 bp, Salmonella enterica serovar Newport SL254
atgaagaaaggcaccgtactcaactctgaaatctcgtcggtcatttcccgtctggggcatactgatactctggtggtctgtgatgcgggtttacccatcccgaatagcactgcgcgtatcgatatggcactaacccagggcgtaccttcttttatgcaggtggtggatgtcgtgacccgggaaatgcaggttgaggcggcgattcttgcaacggaaatcaaacaacagaatccgcagctccacgaaacgttgctcactcaccttgagcaactgcagcaacaccagggaaacaccataaaaattagttatacgacacacgaacaattcaaaaaattgactgcagacagtcaggcggtgattcgcagcggggagtgttccccgtatgcgaacgtcattctttgcgctggcgtcacgttctga

SEQ ID NO: 6687 - DNA, 420 bp, Salmonella enterica serovar Schwarzengrund CVM19633
atgaagaaaggcaccgtactcaactctgaaatctcgtcggtcatttcccgtctggggcatactgatactctggtggtctgtgatgcgggtttacctatcccgaatagcaccgcgcgtatcgatatggcactaacccagggcgtaccttcttttatgcaggtggtggatgttgtgacccgggaaatgcaggttgaggcggcgattcttgcaacggaaatcaaacaacagaatccgcagctccacgaaacgttgctcactcaccttgagcaactgcagcaacaccagggaaacaccataaaaattagttatacgacacacgaacaattcaaaaaattgactgcagacagtcaggcggtgattcgcagcggggagtgttccccgtatgcgaacgtcattctttgcgctggcgtcactttctga

SEQ ID NO: 6688 - DNA, 420 bp, Salmonella enterica serovar Agona SL483
atgaagaaaggcaccgtactcaactctgaaatctcgtcggtcatttcccgtctggggcatactgatactctggtagtctgtgatgcgggtttacccatcccgaatagcaccgcgcgtatcgatatagcactaactcagggcgtaccttcttttatgcaggtggtggatgtcgtgacccgggaaatgcaggttgaggcggcgattcttgcaacggaaatcaaacaacagaatccgcagctccacgaaacgttgctcactcaccttgagcaactgcagcaacaccagggaaacaccataaaaattagttatacgacacacgaacaattcaaaaaattgactgcagacagtcaggcggtgattcgcagcggggagtgttccccgtatgcgaacgtcattctttgcgctggcgtcactttctga

SEQ ID NO: 6689 - DNA, 420 bp, Salmonella enterica serovar Dublin CT 02021853
atgaagaaaggcaccgtactcaactctgaaatctcgtcggtcatttcccgtctggggcatactgatactctggtggtctgtgatgcgggtttacccatcccgaatagcaccgcgcgtatcgatatggcactaacccagggcgtaccttcttttatgcaggtggtggatgtcgtgacccgggaaatgcaggttgaggcggcgattcttgcaacggaaatcaaacaacagaatccgcagctccacgaaacgttgctcactcaccttgagcaactgcagcaacaccagggaaacaccataaaaattagttatacgacacacgaacaattcaaaaaattgactgcagacagtcaggcggtgattcgcagcggggagtgttccccgtatgcgaacgtcattctttgcgctggcgttacgttctga

SEQ ID NO: 6690 - DNA, 420 bp, Escherichia coli O157 H7 EC4115
atgaaaaaaggcaccgttcttaattctgatatttcatcggtgatctcccgtctgggacataccgatacgctggtggtgtgtgatgctggtttacccatccccaaaagtacaacgcgtatcgatatggcattaacccagggtgtaccttcttttatgcaggtgctgggcgtcgtcacaaatgaaatgcaggtcgaggctgccattatcgcggaagagatcaaacaccataatccgcaactccacgaaacgttgctcactcaccttgagcagctgcaaaaacaccagggaaataccattgaaattcgttacaccacgcatgaacaattcaaacaacaaaccgcagaaagtcaggcggtaattcgcagcggagaatgttctccgtatgcgaatatcattctctgtgctggcgtgacgttctga

SEQ ID NO: 6691 - DNA, 396 bp, Alicyclobacillus acidocaldarius DSM 446
atgaagcggtcgggtatactgcatgggcgtctatcgcagatcattgcggaactcggacatggcgaactcattgcggtcgcggactgtggattgcctattccgccagggattgagctcgtggaccttgcgatcaagccgggtatgccttcattcctcgacgtatgcgacaccattctaactgagcttgtcgtagaggactttattgtcgcaaacgaactagccatccgtggctccggtgtggttgatcacttgcgggaacgcgcgggagtgttaggtaaatttattcctcactcagactttaagcaaactttacgtaacgttcgttcagtggtgagaacaggagaatggacgccctacgcaaatgtgatctttgtcgcaggtgttgcattttcataa

SEQ ID NO: 6692 - DNA, 906 bp, Anaeromyxobacter dehalogenans 2CP-C
atgctccccgtcctcttccggatcccgctgcccggcggcgcctcgctgccgctccacacctacgggctgctcatcgccatcggcttcatggtgggcatctggctggcccagcgcgaggcggtccggcgcgggcaggatccccggcggctcgccgacctggcgttctggatcctggtctcggcgctggtgggcagccgcgtctactacatgctcgtgaaccccggcgagttcttctcgccggcgcggttcctggtcgagacgccgttcgggcgcatcccgcgcgtgctcgcgatctggcagggcgggctcgtcttctacggcgggttcatcggggcggcgctcaccgcggcctggtacctgcgccgccaccggatgggcttcctcgagcacgccgacacgctcatcccctcggtggcgctcggacacttcttcgggcggctcggctgcttcggcgccggctgctgctggggcgacgtcgcccacggccacctgccctgggccgcccgcttcccgcccgagtcgctcgcgttccagtcgttcgccgaccggcccgatccgggccagtacctggcgcccgaccggctcgccacgctgccgctccaccccacccagctctacgaggcgttcggcgagctcgggctgttcctcctgctcgtgctcgtggtccgcccccggaagcggttccacggccaggtgctcgccgcgtggctgatgctgtacgcggtgctgcgcaccggcgtggaggcgttccgcggcgacgtggagcgcggcgtcatcctcgggctcggggtgggccagtggacgtcgatcgcgatcttcgcggcaggtgcgacggtgtgggcgcgcgcgcgccgtcccgcgccggccggcgccggcccggccgcggcgcccgccggcgggcgttga

SEQ ID NO: 6693 - DNA, 1083 bp, Anaeromyxobacter sp. Fw109-5
atgcaccccgaactcctgcagctcgtcgtgcccgaggggctcggcgcgctcgtcgccctggcggtgctcgtcatcttcgtggtggggcgcgcggcggcccggctccgcgaggcgcgccgcgcggaggagccgctcccggtggtcgcggccttccgcgcggactggcccacgagcgccgcgctcgcggccgcggcgctctggctctggcgcgcgggcgcgctcgaccgcgagctccgcctgtcgctccacagctacggggtgctcatcgccgccgcgttcctctcgggcatctggctcgcgcagcgcgaggcgcgccgctgcgggctcgaggcggggcgcatcgccgacctcgccttctgggtcctcgtcgccgcgctggtggggagccgcgtctacttcatcctcgtgaactggggcgagtacttcggccccggccgcttcctcctggcgacgcccgtcgggcgcatcccgcgcgtgctcgccgtgtgggagggtgggctcgtcttctacggcggcttcatcggcgccgccctcgcggccgcgctgtacatgcgccgccatcgcatgccgttcctcgcctacgcggacgtcgtcatcccgtcggtcgccttcggccacttcctcgggcggctcggctgcttcgccgcgggctgctgctggggcgggctcgccggcgagcacctcccctgggcggcgcgcttcccgcccgagtcgctggcgtaccggacgttcctcgaccggccggaccccgcgcagtacctcgccccgggcggcgcgacgacgctcccgctccacccgacccagctctacgaggcgttcggcgagctcgccctgttcctcgtcctcgtcctcgtggtgcggccccgcaagcgcttccacgggcaggtgctcgcgagctggctcctcgcctacgcggtgctgcgcaccggcgtggagctcttccgcggcgacgtggagcgcggcgtgtacctcggcctgggtgcggggcagtggacgtccttcgcgctgctcgcggcgggcgcggcggtgtgggtgagtgcgcgcaagacgcgccctgcgccggccgccgcgggtgcgccctag

SEQ ID NO: 6694 - DNA, 777 bp, Candidatus Desulfococcus oleovorans Hxd3
atgcatcccgtactggttaaaatcggtcccctgacctttcacacctatggccttttcgtggccggcgccatcctggcagctgtgtggatggggtcccgcctggcaaaggcccgtgggatttcgccggaaaaggtgatggacctcaccttttacgcggtactggccggcctggccggggcacgcctgttctatgttcttttaaacccctccctgtttcgcggcgactggctgggcatcctgcgcgtatgggaaggggggctggtgttttacggcgggtttatcggtgccctgaccgccgtccttgtatatatccgccggcaccggctggcaggcggaacgatttttgacatccttgccgtggccgcgcccctgggccatgccatcggccgcatcggctgctttttcgccgggtgctgccacggcaaggtctgtgacctgccatgggccgtcacctttaccgatcccatgaccctggcccatccggtgggggttcccctgcatcccacccagctttacgaggcattcgccaacctgctgatttttgcgctgctgtctgccctgtaccacaggaaaaaatttgccaatcgcctttttctggtttacgtgatggtctacggcatcgcccgggccatcattgaaatattccgcggcgaccccaggggctttctgtttgacggcatgctctccacctcccaggccctgggcctgaccgccgcaaccgtggccgcccttcttctggtggtcctgcatatccgcaacaagcgggctgaccggtaa

SEQ ID NO: 6695 - DNA, 906 bp, Anaeromyxobacter sp. K
atgctccccgtcctcttccggatcccgctgcccggcggcgccttcctgccgctccacacctacggcctgctcatcgccgtcggcttcatggtgggcatctggctggcgcagcgcgaggcggcgcggcgcggccaggatccgcggcggctcgccgacctggcgttctggatcctggtcgcggcgctggtgggcagccgcgtctactacatgctcgtgaacccgggcgacttcttctcgtccgcgcggttcctggtcgcgacgccgttcggccgcatcccgcgcgtgctcgccgtctggcagggcggcctggtgttctacggcgggttcatcggcgcggccctcaccgcggcctggtacatgcgccgccaccggatgggcttcctcgagcacgccgacacgctcatcccgtcggtggcgctcggccacttcttcggacggctcggctgcttcggcgccggctgctgctggggcgacgtcgcccacggccacctgccctgggcggcgcggttcccgcccgagtcgctcgcgttccagtcgttcgccgaccggcccgatcccggccagtacctcgcgcccgaccggctctccaccctgcccctccaccccacccagctctacgaggcgttcggggagctcgggctgttcctcctgctcgtgatcgtggtccgcccccgcaagcggttccacggccaggtgctcgccgcgtggctgatgctgtacgcggtgctgcgcaccggggtggaggcgttccgcggcgacgtggagcgcggcgtcgtcctcggcctcggcgtgggccagtggacctcgatcgtgatcttcgccgcaggtgcggcggtgtgggcgcgggcgcgccgttcagggccgtccggcgccggtgcggccgcggcgcccgccggcgggcgttga

SEQ ID NO: 6696 - DNA, 831 bp, Dictyoglomus turgidum DSM 6724
atgtatccaaaattacttacaattccacaattccagtttttgaagtacaaaataggaccaattgttatttactcatggggaacatttgtggctcttggttttctcatcggtatactccttgctatgagatgggctaaaagggagaatattgatccagatcatgtgctcaatgtggcggtatggagcataatctcctccataataggagcaagagcggtctatgtaattaagtactggaatgcttataaaactaatcctatcactatcttgcatctatgggatggcggattaatattttttggagggttccttgtagcattagttgtagttttgctttatttgaaaaggtataagattgattattggaagtttttagacatattagcccctgctgttgctataggaagtgctataggtagaattggatgttttcttaatggttgttgttatgggtatgagactcctctcctttggggagtaaagtttccaaatgtttatggatatagacatgcaacagaactttactatacaatagcttttcttattgtgtttatatatcttttgagagttaaaagtagaaagacctttgacggagaagtagcaactaatttctttatttactattcttttgcttttttccttgtagaaatctttagagataatccccgtaatttcctttatttaacaggttctcagactgtttctttacttttaattgcttttggtatctacgcttataggagaagaagagcagggcgtcctattattccagagcaatgcttattctggaagattatgactacaaagcctaaggtcagtaaaaaaagataa

SEQ ID NO: 6697 - DNA, 906 bp, Anaeromyxobacter dehalogenans 2CP 1
atgctccccgtcctcttccggatcccgctgcccggcggcgcctcgctgccgctccacacctacggcctgctcatcgcggtcggcttcatggtgggcatctggctggcgcagcgcgaggcggcgcggcgcggccaggatccgcggcggctcgccgacctggccttctggatcctggtcgcggcgctggtgggcagccgcgtctactacatgctcgtgaacccgggcgacttcttctcgcccgcgcggttcctggtcgcgacgccgttcggccgcatcccgcgcgtgctcgccgtctggcaaggcggcctggtgttctacggcgggttcatcggggcggcgctcaccgccgcctggtacctgcgccggcaccggatgggcttcctcgagcacgccgacacgctcatcccctcggtggcgctcggccacttcttcgggcggctcggctgcttcggcgccggctgctgctggggcgacgtcgcccacggccacctgccctgggcggcgcgcttcccgcccgagtcgctcgcgttccagtcgttcgccgaccggcccgatcccggccagtacctcgcgcccgaccggctctccaccctgcccctccaccccacccagctctacgaggcgttcggcgagctcgggctgttcctcctgctcgtcatcgtggtccgcccccggaagcggttccacggccaggtgctctccgcgtggctgatgctgtacgcggtgctgcgcaccggggtggaggcgttccgcggcgacgtggagcgcggcgtcatcctcggcctcggcgtgggccagtggacctcgctcgtgatcttcgccgcaggtgcggcggtgtgggcgcgggcgcgccgttcaggggcggtcggggccggtgcggcggcggcgcccgcgggcgggcgttga

SEQ ID NO: 6698 - DNA, 786 bp, Desulfomicrobium baculatum DSM 4028
gtgttcccgacaataattgagatcgcgcccttcatcctgttcggcctcaagcttggccccttcacgctgcatacctacggcctctttgtcgcggcggggttcctgctgggcattgcctggtccatgcgcgaggcgcgggccaggggcctttctcccgacacggtctccgatctcggcttctacatcatcctcggagccatcctcggcgcgcgcgctctttatgtgctgatcaatccgacctatttctggaacaacccccaggaaatcctgatgttctggaaaggcgggctggtcttttccggcggcgccatcatggccacgcttttcgccctggcctttctgcggatcaggaaagagaacccctggctgtggatggacgtcctggctccgggtatcggcctgggcgaagccgtgggccgcatcggctgtctggctgcgggatgctgttacggagcggtctgcgacctgccctgggccatcaccttctttgaccctgagtctctggctccgctgcatgtgccgctgcatcccacccaactctaccacagcctggcgggcctgatctgttttgccgtgaccctggccctcaaatcaaagacgcaaggcacgggccagctcatgggcattttcctgactcttttcggaacgctccggtttgtcatcgagctcttccgcgcagactatcgcggagatttcggacccatcagcgtgacccagatcatcgccctgggggcggtggcactggggctcttcatcatccagcacaggagacgcaatgttctttaa

SEQ ID NO: 6699 - DNA, 750 bp, Desulfohalobium retbaense DSM 5692
atgcatcccatactcgttgatatcggaccgttcacggtctacacatacggttttttcgtcgccgctgccttcctggttgggatggccgtgtccatgcgtgaagccaagcgcctggggttgccacacaaaatcgtccctgatctcggcttttatctcatcctcagtgctgtagtcggcgcccgactgctttacgtccttttggcgcccaaatactttctggcccacccgctggaaattgtgcagttctggaagggaggactggtcttcctcggcggcgccctggccgctgccgggaccacgatctggtttctgcgccgtcgcgaacagccaatctggtcctgggctgacgccatcgctcctggacttacgctaggacaggctgtggggcggcttggctgccttgcggccgggtgttgtttcgggaaagaatgtaccctgccctgggccatcaccttcaccgatcccaaatccctggccccgttgcaccaggcactgcatccgacccagatctaccacgtcctggccggcgtcgcggtctatttcctgttgctgggcactaaacggtggcagcccaaacccgggatgcgttttgctatctatattatgggctacgccgtactgcggtttgtcattgaactctttcgcggggatttccgcggccatttgggtcctttgagcaccacccaatggattgccgccgcgcttgtgatcctcggaatctggctttataggcaaaggagaaacagctga

SEQ ID NO: 6700 - DNA, 477 bp, Ralstonia eutropha JMP134
ttgctcgatgccgcccggcgcgcccgcgcggcgggcttcacgcacctggaggccttcacgccgtatccggtcgaggggctggccgaggccatcggcatgacggcggaccgcatgccgctgctcgcgctgctgggcgggctgaccggcggacttggaggattcctgctgcagtggtatgcggccgtgatcgactacccgctcaatatcggcggccggcctgccggcagctggcagatgttcgtaccggtgacgttctcgctgacgatcctgggcgcggcgctgaccacggtgatcggcatgctggtggcgaaccggctgccgcggctgcggcacccgttgttcgacgcgcccgatttcgaacaggcgtcccggcaccgcttcttcctctgcatccggcccgaagccgcgcaggcgacggcggcgttccgcatgcttgccacgaccgcgccgctgcgcgtgagcgaggtgccgcaatga

SEQ ID NO: 6701 - DNA, 543 bp, Nitrosococcus oceani ATCC 19707
atgaataaaatagctattaaaaattacggccttatggctgaatttgaaacgccggaactgctcgtgcaggcggtgagagaaagccgcctaaatggctaccaggcagttgaagcctatacgcctttccctgtcgaaggattagatgaagccctgggacttcgtcgcgattcattgcctttttttgccttggtaggcggttgtataggggccgttagtatttactttgtggaatattattccgcaaccattgactaccctattaatagcggtggccgtccttatcatagctggcctgcttttattccccccgctgtggaaatggctatcctgggcgctgctttagcggtggtgcttggcatgttgatattaaatagattgcctaaattacgtcatcctatttttggtgtatcccagtttgatatggcggagcgtgatcgcttttttctgtgcattagcgctcatgatccgctatttgatgaaaaccgggcgcagcgttttcttgagagcctggaaccggcaggtatccataaggtcaagggataa

SEQ ID NO: 6702 - DNA, 438 bp, Pelobacter carbinolicus
atgccacggcaactgttcttcgatacaccggaagcttttctgcaggaactgcgtgctcaattggcgtccggcgtaccgcgccggtgtctgcaggtccacctgccctaccacctgcatgaagtcgaggagctgctcatcggccgcccgagtcggctgcgctatttcgcgctgaccggtgggctggcaggcttcggcggcggatttttgctggcgttgctgacctccatcgactggcccgtcattaccggcggcaagcctatcgtctcggtaccgccgtttctgctcgtcggctacctgatgaccattctgatcggatcgctgtcctgcttcgccggatttttatggctggcgcgcctgccgagtcccgaaattctgctggccgggcagccgtttgaatcacgatttgtgctttccatccaagatgaggatgcgacatga

SEQ ID NO: 6703 - DNA, 528 bp, Anaeromyxobacter dehalogenans 2CP-C
atgaagagctacgtcctgggagagttcggcgccgaggccgcgctcctcgacgcggcgcgcacgctgcgcgcgcgcggcggggccaccctcgacctccactcgccgtacccgctgcacggcgccgaggaggcgctcgggctccgcaagtccacggtgcccctggtggcgctggtggccgggatcaccggcgcggtctccggctacctgctgcagtggtacacggtcggctacgcctggccgctcaacgtcggcaaccgcccgccgcacagcgcgcccgcgttcatcccggtcaccttcgagctcggcgtcctgttctccgcgctcgccatcttcgtgggcctgctcgccgtctacttcggcttcccgcgcgtccaccacccggtgttcgaggtggaggcgttccgctccgccagcatcgacggcctgtggctctcggccgaggtggaggccggcgacgccgacgcggtcgcggcggagctgcgccggctcggcgcgcgcctggtctcggtcgtcccggaggggaagtga

SEQ ID NO: 6704 - DNA, 525 bp, Nitrobacter hamburgensis X14
atgacaaagccgctcatcgccgaattcagcgatgctgacagcttgatcagcgcggccgtccgcctcaagcgggagggccatcagcttctggatgcgtttacgccgttccgcttgcccgaactggacagcatcctcatcgtgaagccatccaggattcggctttcgatgttggttggcggtctggcgatggccgctttcttctattttctgcaatggtacagctcggtgatcgactacccgctcaacacgggcggacggccgctcaatagctggccggttttcctcctcgtgccgttcgaagtcggaatgcttgccgctgcattgagcggcttcgccgcattcctgtggacctgtcggctgccgcgcctctatcacccgattttcgacacaacagattttgcgcgcgcgactcaggaccgtttttttctgcttgctgcgcagaccggcaaggaagaacgaagcgcctcgctccgcaagctgttgaagcattcgggcgccgtggccgtgcgggagcaggggtcatga

SEQ ID NO: 6705 - DNA, 546 bp, Candidatus Koribacter versatilis Ellin345
atggaacacgcgcccgctactcccatctacggcctcatggctgagttcgacgacatcggctcgctgctcaacgccgcgaaaaaagcctacgccgccggctatcgccaaatggacgcctactctccgttcccgaacgaagagctttctgacgctatcggtttccctaagacccgcgttccgctcatcgtgctgatcggcggaatcatgggtgggctctcggccttcgcgctgcaatattggtgctcggccatcagctaccctgtcgtcgtcgctggccgtccgtataattcatggcccgcgttcgtcatcccgtgcttcgaactcacgattctcttcgcgtcgctttctggtgtcttcggcatgctcgccttgaacggtctgcctatgccgtatcacccggtcttcaacgtggaccgcttcgccgccgcaagccgcgacaagttcttcctctgcctcgaggccgcggatcccatgttcgaccgcattcggtccgaacagttcctcgccgacctcaagccggaattcatcacggaggtgccccattaa

SEQ ID NO: 6706 - DNA, 531 bp, Cytophaga hutchinsonii ATCC 33406
atggaaaaaggaaagaattttgtatttggtgtgtatgatgatgaagcagtattgatgaacgctgtagatcagattcgcgcaaaaggggtaaagatacatgaagtatatactccatatccggttcacgggcttgacaacgcattaggatatagttattcaaacttacctatcgcaggcttcctgttcggtattgtcggaacaatcacagccttatcaatgatgattggtatgctgggatttgactggccgatggatattggtggtaaaccacacattccgctacctgcttttattccgatcacgtttgaattaacggtattgttttgtgcattaggtatgaccggaacattcttcgttgcaagtaatctgaatccatggtctacaccacagatgtttgatccaagaacaacagatgataaatttgttattgcttttgatactgcatcaaacaaacacgactcagcagctctgaaatcgatcctttcagaaaccggagcttctgaagtaactacaaaatcattggaaaactaa

SEQ ID NO: 6707 - DNA, 525 bp, Flavobacterium johnsoniae UW101
atgagtaataaagttatatacgccatttataatgacgatgacgttttgatgaatgcagtaaagaaaactagagctgctcatcatcatattgaagaggtttttactccattcccagttcacggattggataaagctatgggactagcaccaacaagattagcaatatgcgcttttttatacggatgtgttggtatttctgttgcaacaacaatgatgagttatatcatgattcacgattggccgcaggatattggaggtaaaccaagttttagtttcatccaaaatatgccttcttttgtgccaattatgtttgagatgacggtgttctttgcagctcacttaatggtaatcactttttacatgagaagtagattatggccatttaaacaagctgagaatcctgatgtaagaacaacagatgaccatttcttaattgaagttgctgtaaacgataacgaagcagaacttgtttcttttttcgaaggcactggagctgttgaagttaaagtaattgaaaagaattaa

SEQ ID NO: 6708 - DNA, 579 bp, Roseiflexus sp. RS-1
atgctgaagcgaaatgcgatgcgcgcgaaggcgccaaaggtttcaaccgaaccgggtctgtatgggttgatagctgagttcgacagcgcggatgcgttgctggcggcagctgaaaaaacccgtgatgccgggtataaaaagttcgaagcgtatacgccgatcccgatccatggactggatgaagcggtcggctaccggggcacgcgcctgccatgggttatttttggcgcggggctgctcggtgcgagcgggatgtttgctctgcaaacgtggatcaatgtggtggagtatccgatgaatgttggtggacgaccgctgttcagctggcccgctttcatcccggctacgttcgaagggatggtgctgctgtcggcgttcgccgccgtgtttgggctgattgcggcatgcggtctgccgcgtccataccatccggtcttcaacgcgcccaacttcgagcgagcgtcagttgaccggtttttcctgtgtatcgaggctgccgaccccaagttcgaactcaagcggacgcgccagtttctggagagcctggagccgctggcggtctctaccgtagataactag

SEQ ID NO: 6709 - DNA, 528 bp, Anaeromyxobacter sp. Fw109-5
atgagggcctacgtcctcggcgagttcgagcgcgagcacgcgctcctcgacgcggcgcggacgctgcgcgcgcgcggcgaggcgaggctcgacatccactccccttacccgctccacggcaccgacgaggcgctcgggctgaagcgctccaccgtcccgctcgtggcgctgatcgccggcgtgacgggggcggccaccggctacttcatccagtggtacatggtcgcgttcgactggcccatcaacgtcggcaaccgccccccgcacagcgcgccggccttcatcccggtgaccttcgagctcggcgtgctgttcgccgcgctcgccatcttcttcgggctgctcggcggctacttcggcttcccgcgcacgcaccacccggtcttcgaggtggaggcgttccgctcggcgagcatcgacgcgctgtggctctcggccgaggtggacggcaaggacgccgagccgctcgccgaggagctgcggcggctgggcgcgcgccacgtgtccatcgtcccggaggcgaagtga

SEQ ID NO: 6710 - DNA, 579 bp, Roseiflexus castenholzii DSM 13941
atgttgaagcggaatgcacgacagccaaaggcgctgaaggtctcgaccgggccgaccctgtacgggttgatggctgagttcgatgacgccgaggcgctgctggcagcggcggagaagacacgcgacgccgggtataagcagttcgaggcgtatacgccgatgcctatccacgggttggacgaagccgtcgggtatcgtgggacgcgccttccatgggtgatctttggtgcggggttgttgggggcatcgggtatgtttgctttgcagacctggatcaacctcgtggagtatccgctgaatattggcggccggccgttgtttagctggcctgcgtttatcccggcaacgttcgagggcatggtgttgctgtcggcatttgctgccgtctttggaatgatcgctgcatgcggtctgccgcgaccataccatccggtgttcaatgcgccgaattttgagcgggcgtcggttgatcgcttcttcctgtgcatcgaagcagccgaccccaagttcgaactgaagcagacgcgccagttcctggagagcctgggtccgctggcggtctcgaccgtagataactag

SEQ ID NO: 6711 - DNA, 519 bp, Methylobacterium extorquens PA1
atgagcgccccgctgctcgccgagttcaacaaccccgacgcgctggtgcgggcgatgcggctggccacagccgacggccaccgcgcgctcgacgccttcacgcccttcccggtgccggatctcacgaacgccttcgcgccgccgcgcaacctcgtgcggcctgtgatggctttgaccggtttcggcgcggcggcggcgatgtacgccttgcaatggtactcctccgtgatcgattaccccttgaacacgggcgggcgtccgctgcattcctggccggtcttcctgctggtgccatttgaattcggcgtcctgatcgcagcgatcacggggcttatcgccctgttctggacctgcgggttgccgcgcctgcaccatccgctcttcgcaatcccgcaattcgagcgcgcgagccaggaccgcttcctgctcctcgtcgcgtcgaaggacaccgatgcgacggcgcttcgcgaaagccttgagcgggccggcgctctcctcgtcgcggagatgcacccgtga

SEQ ID NO: 6712 - DNA, 528 bp, Methylobacterium radiotolerans JCM 2831
atgagtgccgccagccgcgcgccgctcctcgccgagttcgagacccccgacgccctggtgcgggccctgcgcctcgtgcgcggcgacggccaccggccgctggacgcctacacgcccttcccgctggaggagctgtccggcgcgctcccgcccgcgcgcaatcccgtgcggttcgtgatggccgtggcggggttcggcgcggccgccgcgatgtacgggctgcaatggtacagcgcggtcgtggattacccgctgaattccggcggccggccgctccattcgtggccggtcttcaccctggtgccgttcgagttcggagtgctggcggcggccgtcgcgggcttcgccgcgatgctctgggcctgcggcctgccgcggctcaaccacccggtccacgacatgccgcagttcgagcgggcgagccaggaccgcttcctgctcctcgtcgcgccgaaagccgagcccgcagcgctgcggctgcggctggaggaggccggcgcggtcctcgtgtccgagttgcgggcatga

SEQ ID NO: 6713 - DNA, 543 bp, Opitutus terrae PB90 1
atgtcctccgtttccgtccaaccttacggcttgatcgccaccttccagacgcccgccgcggtctatcacgcggcggagcaggtgcgcgacgccggctacaaatactgggacgtcatcgccccgtgtccgattcacggcatggacaaggccatgggtttgaagcgctcgatcgtgccgcggatttccctcgtcggcggcatcacgggcttctgcaccggcatgacgtcgatctggtggatgaacgcctacgactatccgctgatcgtcggcggcaagccgtatttctcgccgatgttcgcgtttccgatctcgtatgagctcacgatcctgttcaccgcgttcgcgaccatcatcggcatgttcctggtgaacggtttgccgatgcactatcacccggtgctgaagtatccgaagatcaagcgcgggatggacgaccagttcttcatcgtcatcgaggcgcgcgacccgcgcttcaacgcggccaacacccgcacgctgctggagaaagctggcggcggcgaaatcacggagctcgaggcctga

SEQ ID NO: 6714 - DNA, 519 bp, Methylobacterium populi BJ001
atgagcgcgccgcttctcgccgagttcgagaccccggaggcgctggtgcgggcgatgcgcctggctcaggccgacggccaccgcgcgctcgacgccttcacgcccttccccgtgcccgatctcacggacgccttcgcaccgtcgcgcaacccggtgcggccggtcatggcggtggccggcttcggggcggccgccgcgatgtatgccctgcaatggtattcgtcggtgatcgcctatccgctcaactccggcggacgggcgctgcattcctggcccgtcttcctgctcgtgccgttcgaattcggggtgctggcggcggcaatcgccggtctcgtggcgatgttctgggcctgcggcctgccacgcctgcatcatccgctcttcgcgatcccgcaattcgagcgggcgagccaggaccgcttcctcctcctcgtcgcagcgaaggatgcggatgcgacggctttgcgcgagagtctggaacgggccggcgcgctgctcgtggcggagatgcatgcatga

SEQ ID NO: 6715 - DNA, 561 bp, Akkermansia muciniphila ATCC BAA 835
atgaaaaagcccgtcatttccggctgggtgctttccttcggttcggagaaggcgctccttcaggccgtccgcgtgctggtgaaggaggaaaatctgcgctgggaggtttgcgcaccttacccctgcgccgctgttcgttttgccaacaggcacgccgggaaggccgtgggagcaggcgttcggctgtgggccgcagcgggcggcgtctgcgggtttctggccgtggctctgtggctttactggacgcagttctgtgcggatccccttgtgacccagggaagggtccagggctgggacagctggcccgcatatgtccctcccctgtttgaaggaactttgctgggggccggattgctgaccgccgccggttttctgaagggggctcttctcccgcaatggcacgactgggcgttcgagtgtgattttttcaggacggatgagcacgggaacggttacttcattctgctggaaggcgggagcgaaggctatgccgccgttttggctgaagccctgcatccggatgcctgcgagtacgttcatgggaaaggaggccgggcatga

SEQ ID NO: 6716 - DNA, 528 bp, Anaeromyxobacter sp. K
atgaagacgtacgtcctgggagagttcggcgccgaggccgcgctcctcgacgcggcgcgcacgctgcgcgcgcgcggcggggccaccctcgacctccattcaccgtacccgctgcacggcgccgaggaggcgctgggcctgcgcaggtccaccgtgccgctcgtggcgctggtggccgggatcaccggcgcggtctccgggtacctgctgcagtggtacacggtcggctacgactggccgctcaacgtcggcaaccggccgccgcacagcgcgccggcgttcatcccggtcacgttcgagctcggcgtgctgttctccgcgctgagcatcttcgtcggcctgctcgccgtctacttcggcttcccgcgcgtccaccacccggtgttcgaggtggaggcgttccgctccgccagcatcgacggcctgtggctctcggccgaggtggacggcggcgacgccgacgcggtcgcggcggagctgcgccggctcggcgcgcgccaggtctcggtcgtcccggaggggaagtga

SEQ ID NO: 6717 - DNA, 519 bp, Methylobacterium sp. 4-46
atgggagagatgctggcctgcttcgcggatccccacagcctggtccgggcggcccgcacgttgcgcgcgcggggccaccggcccctcgacactttcacgccctacccggtggaggcggtcgagggcgtgctggacccgcgcccgagccgcctgcgctgggcgatgctggccgggggcgtcggcgcggcggccttcgcgtatctcctgcaatggtacgccgcggtgatcgactacccgctcaattccggcgggcgcccgctgcacagctggccggtcttcctgctggtgccgttcgaggtgggggtgttcgcggcggcgctggcggggctcctcgccttcctgtggggcaccggcctgccgcgcctgcaccacccgctcttcgcggtcccgggcttcgagcgggcgagccaggaccggttcttcctgctcgccgccgcggcggcgccgggcgacggcaccgccctgcgccacctcctggaggagaccggggccctcgtggtgttcgaggtgcggccatga

SEQ ID NO: 6718 - DNA, 519 bp, Gluconacetobacter diazotrophicus PAl 5 JGI
atgatcgtcgccgccttcgccaccgaggccggaatgcggaaggccgccgccgaaatccggcgcggcgatcccggattcgtggaaacctacatggcgatggaaccgcgcgaggcggaagacgacggtgccggggacgggcatatggcgggcggttccatcctgccggcggtcatgctgttcggcgggatcgtgggcgggctgggcggcttcctgatgcaggcctatgccacgaccatcagctatccgcagaatatcggtggccggccggacctgtcctggccgtcctatgtgcccacgaccttcgaactggcggtcctgggcgcggtggtcgccggcatggccggatacctgctgctggcccggatgccccgcctgtacgatccggtggacgaggccgagtgcatgcgcaccgccatgctgggattctatgtcctggtcgcgcgccccaccgacagcgcccgcgcgcaccgggtcctggcccgccacgccccgatcgggatcgaggaggtagcggaatga

SEQ ID NO: 6719 - DNA, 519 bp, Methylobacterium chloromethanicum CM4
atgagcgccccgctgctcgccgagttcgacaaccccgacgcgctggtgcgggcgatgcggctggccacagccgacggccaccgcgcgctcgacgccttcacgcccttcccggtgccggatctcacgaacgccttcgcgccgccgcgcaacctcgtgcggccggtgatggctctgacaggcttcggcgcggcggcggcgatgtacgccctgcaatggtactcttccgtgatcgattaccccttgaacacgggcgggcgtccgctgcattcctggccggtcttcctgctggtgccgttcgaattcggcgtcctgatcgcggcgatcacgggcctcatcgccctgttctggacctgcgggttgccgcgcctgcaccatccgctcttcgcgatcccgcaattcgagcgcgtgagccaggaccgcttctttctcctcgtcgcgtcgaaggacaccgacgcgacggcgcttcgcgagagcctggagcgggccggcgccctcctcgtcgcggagatgcatccgtga

SEQ ID NO: 6720 - DNA, 528 bp, Anaeromyxobacter dehalogenans 2CP 1
atgaagacgtacgtcctgggagagttcggcgcggaggccgcgctcctcgacgcggcgcgcacgctgcgcgcgcgcggcggggccaccctcgacctccactcaccgtacccgctgcacggcgccgaggaggcgctgggccttcgcaggtccaccgtgccgctcgtggcgctggtggccgggatcaccggcgccgtctccgggtacctgctgcagtggtacacggtcggctacgactggccgctcaacgtgggcaaccggccgccgcacagcgcgccggcgttcatcccggtcacgttcgagctcggcgtgctgttctccgcgctgagcatcttcgtcggcctgctcgccgtctacttcggcttcccgcgcgtccaccacccggtgttcgaggtggaggcgttccgctccgccagcatcgacggcctgtggctctcggccgaggtggaggccggcgacgccgacgcggtcgcggcggagctgcgccggctcggcgcgcgcctggtctcggtcgtcccggaggggaagtga

SEQ ID NO: 6721 - DNA, 528 bp, Methylobacterium nodulans ORS 2060
atgggagagatgctcgccgccttcgcggatccgcagagtctggtccgggccgcccgaacggtgcgggagaggggccaccggcccctcgacaccttcacgccctatcgcgtggaggatgccgagaccgtgctggagccggaagagcgcccgacccgcatccgctgggcgatgctgatcggaggcttcggcgtcgcggctctggcctacggcatagagtggtatagcgcggtcatcgattacccgctcaattcgggcgggcgcccgctccacagctggccggtcttcctgctcgttcccttcgaggtcggggtcttcgcggcggcgctcacggggctcctcgccttcctgtggggcagcggcctgccgcgcctgcaccatcccctcttcgagatcccgggcttcgagcgggcgagccaggatcgcttcttcctgctcgctgcggagacgaacgcggagggcgacggcatcgcgctgcgtcatctcctcgaggaggcgggcgccctcgtggtgttcgaggtgcggcgatga

SEQ ID NO: 6722 - DNA, 561 bp, Rhizobium leguminosarum bv  trifolii WSM1325
atgcgtgaacccagcgcagacattgagcctttcggtatccttgtggaattcgacgcgggcgagaggttagtcgaggcagcaggaaggacccgcgcagaaggcttctgctcgctggatgcctactcgccatttccccttccaggcctgtcggcggccctggacgtagaagacaaccgcgtaccttggatcacaattctgggcggcggtttcggcgcggctgcaggctatgcaatgcagatctacaccaattgggattttccgatcgatatcggaggacgcccgctttttgcatggcagcctttcatgctgattaccttcgaaacctgcgtgctctttactgtgctggccgccgtattgggaatgcttcttctcaatcggctaccccggttgcaccacccggtgtttgacattgacaggtttaacctcgtcagcactgaccggttctttctaatcgtgttcggaaacgacccgcgttttgacgtagaggcgacggcagagttcctgcgttcgctgaatccggtgatgcttttcatcgtgggccagacggaggagccggaatga

SEQ ID NO: 6723 - DNA, 537 bp, Pedobacter heparinus DSM 2366
atgaataatatcaaatatattttaggcagttttggtgatcctgatgaaatgatgcatggcatcgaaaagctgcaggaaaacaacattaagatacatgatgtttatacaccaatgcctatacacggcatagaagctaaattaggggttaaacgttcaaggctagatattgctgcattcttttttggaataacaggaacctgtaccatgcttacgtttgtatattttgcagctgcttacgactggccgatcaatattggtggtaagccacattttgccctgccggattttattccgattacatttgagctaaccatattattttgtgcttttggtttggtaggctcttactacgcatcgacacatttatttcctggaagagcaccgagggtgatggatttaagggcaactgatgacaggttcatcattgcgattgatgcaaaagaaaataccgagcacagtaagatagatgatttattaaagcaagcgggtgctttggaagtaaagcataatgaaaggaagtatgttagctatgaataa

SEQ ID NO: 6724 - DNA, 531 bp, Dyadobacter fermentans DSM 18053
atggcagaattatctggtaaatatttggtcggagtttacgacgatgacgatactgttcttcacgcggttcccaagttgagaaaggccggtgtgaaaatcaaagaagtatattctccattccctatccacgggttggacgaagcgctggggcacccaagaacgcgtattggtatcgctgcctttatgttcggtgtaacaggatgctgcgccgtgctgaccctgatgatctggacaatgggatatgactggccgatgatcatcggtggtaaagatccgatctcgatccccaactatatccccattacattcgaaggaacggtactcttcaccgcattcggtatggtgaccaccttcctgatttcgaacggactcggacccggttcacatttccacccgagatttgacgtacgggccacggataacaagtttatcatggcgatcgacatgagcagaaactcaatgagcgaagaagagatatcgagagcgctgaaagacagcggcgcagaagaagtcaacattaagcaattctaa

SEQ ID NO: 6725 - DNA, 540 bp, Chloroflexus aggregans DSM 9485
atgcgtaacgatgtctacggcgtgatagcagaattccctacgcccgaagcgttgatcgaagcaacccggaaagccaaagcagcaggctacacgaagatggacgccttctcacccttcccaatcgaagaggtgattgaagagattgcccacggcgataccggtgtgccacgtctagtgctactgtttggcttgatcggtgccgctaccggctttattctccagtatatcggtaatttgattgattacccattgaacatcggtgggcgccctctcgatattaccaactggccggcaatgatcccgatcaccttcgagagtgggattctgctcgcgtcatttgcctcggcgattgggatggtggtgctcaatggcctgccggctccgtaccacccggtctttaatgtaccccggttccagtatgcgtcgcaagacgccttcttcttgtgcattgagtcgacggatccgctgtttgatcgttcgcgcacttcgcaattcctgcgctcactcaatccgatgcaggtttcagaagtgccatactga

SEQ ID NO: 6726 - DNA, 594 bp, Chitinophaga pinensis DSM 2588
atggcggttaaaaattttgttgtagcaagttttagtgatgaggcggtattgtttccggcagtgaaaaaagtaagaactgcgggttacaagttacacgatgtgtacacaccatttccggtgcatggtcttgaccatgcaatgggtctgcgcgaaaccagcctgcacactgccggcttcatatacggtatcaccggtactactacggcattatcctgcatgagctgggtatttaactctgactggcctatgaatataggtggtaagccacacttcccgctgccagcattcatacctatcactttcgaattgacggtattgttttcagcagtaggtatggtgctcacattctgctacctgtgtcagctggctcctttcgtaaagaaacatatcttcaatccacgtcagacggacgataagttcgtgatggcgattgaagtaactgctaaaaccaatgctgaggaactgaaaagattcctggcaggtctgggcggcgaggatgtgaacgaacagcgtgttgaatcaggttggtggttcggtcgttttgaccgtgaagaccgcctgtttgaaacaaaagttgaggctgtaaacgcataa

SEQ ID NO: 6727 - DNA, 549 bp, Arthrobacter FB24
atgagcgcattgcacctggtccccacatctcccgcgttggaacgaccggcggccggtgaccagccagcccgccggctggcagcagtcccggccgccggcagccctgccccgcgtcagcacacggccggcacgccgccaacgcctcggccgggtgacccgggtgacgccaccaagaacgggcgggccctgcagatagtgagcgagaacaaggaggtctgcgcaattacccgcggtaccgtccaggccgccatcgaagtgctggcaggaacacgtcccatccagcaactctcccgaaggcttgatcagcggtgcctggcctcactccagcaccgcgcggcgctgacccgtcggctggcggcgggaccctcacccacggcaggacgcctgcaccgtaatcccgcagtcagatcggtccgcgcctgcgaagtcgcgtccggagtctacgaggcaagtgccgtagtagtggatgaactaagggtccgcgcagtcgccgtgcggcttgagcgcagcaatcaggtatggcggatcacggctctggagatcggctga

SEQ ID NO: 6728 - DNA, 519 bp, Nocardioides JS614
atgaacaacccggagaccgaccagaccgtcgtcgtgctgcgcgcggcggccgtgccgctcgccagtgtgcagggcacgctcgccctcgacctgcagccccgcttcgacccgccggacccgatcgtcccccacggccacgccgcggccgacgtgatcgcgatcgagcagccgctgcgtcgcgggttggagcagtgggcccgccggtacacgcaggcggcggtcgagatcgtcggcggcgaccgaccggtctcccagctgctgcgctggagctcacgcgaggtctacgagaacctcgaccgtcgcgctcagctggtcgcccgcgccgggcggcaccagcccggccagggccgggtccagccggtccggcccagggtgctgggggtgcacacctgcttcctgtcccgcgacgccgtcgaggtcagcgcgcacgtgcggtacggcgagcgctcccgcgcgctcgccgcccgcttcgagatcaccggccaacgctggtgctgcaccgcgctggagtttgcctag

SEQ ID NO: 6729 - DNA, 594 bp, Salinispora tropica CNB-440
atgactgctgtccgccgccccgagccgactcgtccccccgtccggcttcgcccggccccgtccatcgacccaccctgcgccgaagacgaccccgcccgccggccgctcgacggccaactcgcgctcgacctgttccagacgggcccggacccactgccccgcccacccggccagcgccgcagggccggaccgggcccggccgggccccggcgcgcaccgacccgggtgcccgccacgacgctggtcaccgccaccccggaggcgatccgggttgcgcatcgcttcgtcacgacctgtctggaggtgatcaacggctatcgagcccccagccagctacgccgactgctcgacccgacccgggcggccgagctggtgcccgagctgacccgcgccaccggccgcgcggggccggtgcgacgccgctccacccggcccggcacgcgcctgcgccggctgcgggtgtgcgagccacgagacgcggtcgtcgaggcggccgccgtgctggccggaccagctggctggacctgggccatggcgatccgcctcgaacagcgccgcggcagctggctctgcaccgccctcaacgtgctgtga

SEQ ID NO: 6730 - DNA, 726 bp, Frankia EAN1pec
gtgaccgcgacgaccgccctgaccctgccccgtcgccggcgtccccatgtcgccacaacgccccggttgatgcccgtgcgtcccatcgacccgccctacgacgatgaaaccgtcccacccgagcagaccgcgccggccgggcgagccccgggaaccgaccggtccgcgggtgcccggtattcacgagtcgcggcgccgaccaccacgccaaacgccccgtcgaccgctatgggcgcgccggccaggatggtgtcccgcgccgaacgcggcgccgcccgccacctcctgccggaccaacggaccctcccgtggccgcagcccgcccgaacgacccgcacgccggcgcgccagccggcggacggtgccgccgcggtggcaccgcggctcgcggcacgggcaccgacgggcccggggacgtcaccggacccgcgccggaccgcggccgtcgtcgtgcgagtgatcatcgaggtgttgtccggagcccgcccggccgcgcatctggccccctggagcacggccgccctgcagagcgacttccagcggacggcctcgtccctggccacccgtcagccttcgcaggtgcgcagcgtgcgggtcagcgagccgctgcccggggtcgcggaggtcagcgccgtggtcagcaggggtcccagagtacgggcgctcgcgctgcggatggagcacgcggccggccgctggcaggtgacgaccctccagctcggctga

SEQ ID NO: 6731 - DNA, 588 bp, Salinispora arenicola CNS-205
atgtctgacgtccgccgccccgagccggcccgtccccccgtccgacttcgcccggcaccatcgatcgacccgccctacgccgaggacgacccggcccactggccgatcgacggccaactcacgctcgacctgtccaaggcggcccgggatccactaccccgcccacccggccggcgccgcgggccaggatcggccgggccgcgccgttcaccagccccgcttcccgccacggcgctggtcaccgccacgccggaggcaaccaggatcgcgcaccggttcgtcatcacctgcctggaaatgctcaacggctatcgaccgccccgccaggtgcgcccactactcgacccggctcgggcagccgagctgatgcgcgagctggcccgggcaaccgcccgctcggggcccgtgcgacgccgctccacccgacccggcacgcgcctacgccggctacgggtgtgcgagccgcgagctgcggtcgtcgaggcagccgccgtgctgaccggaccagccggctggacgtgggcgatggccatccgcctcgaacgccgccgcggcagctggctctgcaccgccctgcacatcctgtga

SEQ ID NO: 6732 - DNA, 528 bp, Arthrobacter chlorophenolicus A6
atgccagccgtaacgccgatccgtgccctccagggaagaaccgccagtaatgtcgagaagggcttcgccaatggcacaaccagccaggaggccctgcgacagacgcagctgcgggccttgggcccgggccggttggccccgcatcccggagcgccggttcagctccgggccgcggacgaggaagcggaagtccgggcccttacacggggaacagtgcaggctgccatggaagtgctggccggtatccggcccgtccaccaacttgcccgccggcttgacccccgttgcctcgctgccctccagcaccgcgccgcactgattcggagggaaatcaccaggaccggaaatcctgcgctgggccgcctgcaccgcaactccattgtccggtcagtgcggatctgcgaagtggcagaaggcacctatgaagcaagtgcagtcgtggtcgatgacgtacgtgcccgcgccgtggcaatccgactggagcgcagcaagcaggtctggcgggtcacggaactggtcattgggtga

SEQ ID NO: 6733 - DNA, 402 bp, Brachybacterium faecium DSM 4810
atgaccaccacagaccagcgccccgtcccctccggcaccagcacctcgagcctcgctccgcaggatccacgctccgtcgagcagctcgtcgccccggtggcccggcgtgccgtcgagatcgtgcgggacatgcggcccgagaactcgctgtcccggctcgtgacgccggaggtcgggcagcacctggcgcggcgcgccgcgctgacccgccggctgagggcctcgaccggctatgcgccgacgagacagctcgaggtcaccggcgtgcgcatctgcgtggtcaacgcacggaccgtcgaggccagctgcgtgctgcgcgaacccgaccgtgcgcgattcctcgcgatgcggtgggagctgcggcactcggggtggcgcgtgaccgtgctggagatcggctga

SEQ ID NO: 6734 - DNA, 513 bp, Micrococcus luteus NCTC 2665
atgaccgccctcgccacccgcccccgcaccgcttccgcacggcgcaccgccgacaccctcctccatgggcccgcccacagccccgcggtcctgccccgcggtgaggagatcgcccggcgggcccgcaccgagcaggggcgcgaggagctgcgccgcgtccgctcgctcgccgccgtgatcgccgtcgcctgcgtcgaggtcgagacgggccgccgtgccctgcgggacctctccgcctggctctcgcccgaggtgctggacaagttgacccgtcgcatggagctgctgggcgccgtcgcgccggccgggcccggtcgacgacccgccccggccgtcccgccccgggcgcccgcgtccgcaccccgcccggtgggtgcccgcgtgtgcgaggtcgcgcccggccgggtggaggccagcgcgacggtgctgtgggagggccgggcccgggccttcgcactccgactcgagcggcggctcagccgctggaaggtgacgtcggtcgagatcggctga

SEQ ID NO: 6735 - DNA, 387 bp, Kytococcus sedentarius DSM 20547
atgagggcgcagcagggcgcagccgagatcggcttcttcgaccgtcagcccacctccaccgccgacctcagcccggccctcccctgggcggcgcacctcagccggtcgatcatcgaggtcatggagggctcccgcgacccgcagcagctcacccgctgggtggcgcccgacatcctcacccggctggcccggcgcaacgcgctctcccgccgcttcgggaccgccaccggggccaccggcgtgcgcacggtccgcgcctgccacgtgcgcgacggcatcgtggaggtcaccgccgtcgtggtgatccgcaaccaggtgcgtgccctggcgctccgcctggaggggctcgacgggcggtggttgctcaccgtgctggaggtcggctga

SEQ ID NO: 6736 - DNA, 1140 bp, Catenulispora acidiphila DSM 44928
atgacaccagtgcgatcggtccgcgcgatcgggacagccggggtcggcgcgcactggcggcgggataacaggccagacttcccaggcatcgcggtgtgggtggacgcggtcgcggaaattgagatcgaaactggggcgttcggagacagcgacgaagagggcgaattcagtgctggcgagcgggcaggtggcgagtcgcgcagcagcgggcgcggcagcgattgggctgatggcgagcggggcagcgccgggcagggtgacagcgagcgggctgatggcgaatcgcgaggcagtaggcacatcggcgactgggccgacagcgaatcgctaggcagcgaccagggcgcgggtgcgcgggcctcggctgcgcggcttggcagcgactgggttgatggcgagtcgcgaggcagcgaccagagcgctggtgcgcgggccaacggtcagcggcttggcggcgactgggccgacggcgaatcgctaggcagcgaccagagcgctggtgcgcggcccaatggtcagcggcttggcggcgaccggtccgctggttcgcaggactcggatgatgccggactcgtgccgtcgtcggtggatgcttggtcgccggagtatgccaaggtgtggcgtcctttgtcgggcgctggtcgtgaaccgcgccccgggctgcttgtgtcggtcgtgcgggcaggtgcggtggtcgcctatccgacgccgttgcccgatcctcccaccggcgcgctggcgcgagcgttggcgcggcttgagcgcccggcagtcgagcgccgtcctcacatcctgccgatcgaagccgctccggcacccgcgccgcctcgccgtcccgcgccgtcgcagaagacgtatggcgaagtaagagccctggtcggcgtcctggtcgagatcctcagaggtcatcgcgccgccacccacgcggctcgctggaccgatcccgaggtccgcggcaaactccgtaccccgcgttacgcccgcaccgcgtcgctgaaatcggtccgtctcgccgagagtggcgacggcgtcgaagccctcgcgctgctccaagagggcggccgcactcatgtcgtcgccctgcgtttcgaccgtgccgaggactcgcgatggcgctgtaccgcgcttcagaccggctga

SEQ ID NO: 6737 - DNA, 480 bp, Saccharomonospora viridis DSM 43017
atgcgaacgttccagtcggacaacgggctgcttccactcagtccgtacgagccggccgaactcggcgatctggccaagggggaaatcgccgaagggcaactgacgctcgatgacctactggccgaactgcatgcgcaacatcccacgcactacgagcgcaccattcccgcccccggacgacgaatgctgcaccgggttctcaccgcgctcttggaagtccacaccggacgcagggccgcggcccagctcgacaactggctgacacccacactgcagcggctgatccggaccgcgccccgcgcggtcggcacccgctacgtcctacggaacatccacgtgtgccgaccggccgacgacgcactggaggtatgcggcaccgcctacctgaacaaccgggctcgtgccctcgtggcgcgcttcgagcatggtgtaacaggctggcgttgcaccctgttcaccatgctcgagcctcgccgctaa

SEQ ID NO: 6738 - DNA, 453 bp, Jonesia denitrificans DSM 20603
atgacctcgacactcgactcagttctccttcccgcttctccccccgtgcgtgatgcgcttcctgcgcatctgatcactgaggacaccccacatgaggatcggttggcgcgaggccgtgaactgggggacccgaccgcgatctgttgtgcagttgctcgaagcgctgttgaagcgtttcacgggatccgccccatccaccaactcgtctcgcgtttggcaccacatgttctggaatcgttgacagctcgtgcgcaggtccgcgcctcactgaacacggggaccgcaacgagacaccagccagtcaggattgtgcgggcacgcgtcgtgcgtgtctctcctatcgcggccgaggccacggtgattattgcggatggttcgcgggtgcgtgcagcagcgatccgagtggaggaacaccgtggccgatggcgcgcggtcgaccttcaaatcggatag

SEQ ID NO: 6739 - DNA, 900 bp, Rhodoferax ferrireducens T118
atgaccgagccttctttgaattacgtcctgtgccccgacacctctggtggacaccgcatggcttattggcaatggggcaacccagaggctggccatgtggtggtttgcgtgcacggcctgacgcgccaggggcgtgactttgatgtgctggcgcaggccttatgcgagcgcgcgggcgacagcctgcgcgtggtgtgtccggatgtggcgggccggggccagagcgattggctgaaggacccgcagggctaccagattcccgtctacgcggccgacatgctgacgctgttgacggcacttcagcccaccacgctggactggttgggcaccagcatggggggcttgattggcatcgtgctggccgggcagcccgagctgccgttaccggtgccggtgcgccgcctggtgctcaatgacgttgggccggtgatggagtggcaggccttgcagcgcattggcgagtacctgggccagaccggccgatttgactcgctgcagcaggccgccgatgccctgtgggtgatcgccagcagttttgggccgcacacagcggcacagtggctggccttgtcgcagccgatggtcagaccgctgggcgacgggtcgggtgcgctcacattgcattacgacccggcgctggcgctggcgtttcgcgcgctcactccagagtctgccgcgcaaagcgaagccctgttgtggcagttgtatgaccagatcaccgcccgcaccctgctggttcgcggtgctgtttcagacctgctcacgatgcaaaccgcgcgggccatgatggcgcgcggcccccaagcgcggctggccgagtttgccggcgtgggccacgcccccacgttcatcgcctgcgatcaggtgaaagcggtcgcctcttttttactggatgactag

SEQ ID NO: 6740 - DNA, 930 bp, Polaromonas JS666
atgactgaacccagcctgaaccacgtaacttgcccggatgcctcgggaggccaccgcatggcctattggcagtggggccggcctgatagcgggcatgtggtggtgtgtgtgcacggcctgtcgcgtcaggggcgtgactttgacgtgctggcgcaggcgctttgccagcaagccgagcaggctgcgccaggatccggcggccttcgtgtggtctgccccgatgtggtcggacgcggtgaaagcgactggctgaaagatcccatgggctaccagttgccggcttatgcggctgacatgctggtgctgctggcccatttgcacgcccgggcgcccattacgacgctggattgggtaggctccagcatgggcgggctgatcggcatgggggtgtgcggccagccgggtctgccgttgcctgttccggtgcggtgcctggtactcaatgatgtcggtcccgccattgagtggaatgcgattgtgcggattggcacctacctgggccaggcggggcatttcggctcagtgcaggaggcggccgatgcgatgcgggccgtttcctccagctttggcccgcatacccctgagcagtggctggctttgtcgcggcatatggtcaagccggtgtcgcagtctgcagacagcaagtggcggctgcattacgacccggcgattgcggtgccgttcaaactggctaccgaggcctccacgctccagggcgaagccgcgctctggaagctttacgaccatatttctgcccggacgctgctgatacgcggtgcgctgtccgatcttctaagctccgagacggcctatgccatgacgcagcgcggtccccgtgcccgtttggtggagtttgaaggtatcggacacgtccccacgttgatcgcggacgatcaggtcgcggcagtaacgggcttcctgctgggctga

SEQ ID NO: 6741 - DNA, 993 bp, Acidovorax avenae citrulli AAC00-1
gtgccccagagacgattgcccgccatgacagagcctacgctgaactacgtacattgcccgggtgccgcggcatcccccggcaccaccacggagggcgagggcgggcaccgcatggcttactgggagtggaacgccacgggcgaccccgcgcatccccacgtggtcgtctgcgtgcacggcctgacgcggcagggccgcgacttcgacgtgctggcgcgccggctcgcgcggcacgcgcgcatcgtgtgccccgacgtggccgggcgcggccgcagcgactggctggccgacgcctcgcactaccagatccccgtctatgcggccgacatgctcgcgctgctcggccacctgcatgtgcgggcgcccgtgcgcgtgctcgactgggtgggcaccagcatgggcgggctcatcggcatggcgctgtgcggccagccggagttgccgctgcccgcgccggtgcgccggctggtgctcaacgacgtcggccccacgctggagtggccggcgctgcagcgcatcggccagtacgtgggccgcgtggtggaattctccagcgtggcggccgcggtcgaggggctgcggatcgtttccacgggtttcggcccgcacaccgccgaggaatggcaggcactgtccgaacccctgctgcgcccgcagccggacggctccgtgcgcctgcactacgacccggccatcgccgagaatttccgcaacctcacgccagaatccgcgcgcgcgggcgacgcccagctctggcaactctacgacgccatccgcgcgcggaccctggtgttgcggggcgcggaatcggatctgctgctgccggccaccacgcaggccatggcgcagcgcggaccccgtgcccgtgtggtcgagtggcccggcgtgggccatgcccccaccctggtggccgcggagcaggtcgatgtggtggaacagttcctgttcggcgccgggcagggtggcccaggagcggtggaggcgcgcccatga

SEQ ID NO: 6742 - DNA, 936 bp, Acidovorax sp. JS42
atgattcaacctacgctgaaatacgtaccgtgccccggccccgtggccgccggccacccggaacaaggtcatcgcatggcctactgggagtggaacgagacgggcgacgcggcccatccccatgtgatcgtctgcgtccacgggctggcacgccaggggcgggacttcgacaccctggcacgcgcgctggcccgccatgcgcgcgtggtctgccccgatgtcgtggggcgcggacgcagcgattggctggccgatccgatgcaataccaattgccggtgtacgcggccgacatgctggccttgctggtccagctgcatagccagggccccatcgccaccctggattgggtgggcacgagcatgggcgggctcatcggcatgggcctgtgcggccagccgggagtgttgccggtacccgtgcggcgcctggtgctcaatgatgtggggccgcgggtggagtggcaggcgctcgcgcgcatcggccagtacctggggcagcccgcgcatttcgcgacgctgcagcaggcggccgacgcgctgtgggcggtgtcgcgcagcttcgggccgcacacacctgcgcagtggctggaactgtctcgcgccatggtgcgcgaggcgccccaagggggcttggccctgcactacgacccggcgatcgccgtgccctttcgcgccctcacgcccgaggccgcgctggcgggtgagcagcagctatggcagctgtacgaccagatcccggcccaggtgctgctgctgcgcggcgcggagtcggacctgctgtccagcgccacggcgcgcgagatgaccgcgcgcggcccgcgtgcgcggctggtggagttcgccggcgtgggccacgcgccgacgctggtgcagccggaccaggtggccgtggtcgcgcagttcctgctggagcggcaggaggagttgacagcatga

SEQ ID NO: 6743 - DNA, 921 bp, Polaromonas naphthalenivorans CJ2
atgactgaacccagcctgaactacgtcacctgtgccgatgcagccgagggccatcgcatggcctattggcaatggggccagcccgacagcccgcatgtcgtgctgtgcgtgcatgggctgacccgccagggacgcgactttgacgtgctggcgcaggctttgtgcgagcgggccggggcatcgtcttcgggcggcatccgcgtggtttgccccgacgtggcgggccggggcgaaagcgactggctcaaggatccgatgggctaccaggtgccggcctatgcggctgacatgctttcgctgctggcgcacctgcaggcccgctcgcccatcagcacgctggactgggtgggcaccagcatgggtggactgatcggcatggtggtttgcggccagccgggcttgccgcttccggtgccggtccgcaaactggtgctgaacgatgtcggtcccacgctgcagtggcaggccattcaacggattggtgcttacctggggcagtccggccatttcaatagcgtgcaggaggcggccgatgcgatgtggaagatttccgagagctttggcccgcacacgcccgagcaatggctggcgctgtcgctgcccatgatcaagccggtgtcgccggacgcaggcagcccgctgcgcctgcattacgacccggccattgccggcccgttcaggttgaccaccgaagaaggcgcgcagcagggcgaggccacgctctggcagctttacgatggcatccaggccgaaacgctggtgctgcgcggcgcgcagtccgatttgctgagcccgcagaccgcccatgccatgacgcaacgcggcccgcgcgccagagtggttgagtttgaaggcgttggccatgcgccgacgctggttgcgaaagaccaggttgccgcggtggccgatttcctgctttga

SEQ ID NO: 6744 - DNA, 879 bp, Verminephrobacter eiseniae EF01-2
atgcaccgcatggcctattgggagtggcgcgggtggggagcgtggaatgacaccggccacccggcccattcccgggtggtggtgtgcgtgcatggcctggcgcgccaggggcgggatttcgacagcctggcccgcgccctcagcccgcatgcgcgcgtgatttgccccgacgtggccgggcgcggccaaagcgactggctggccgacccgatggcctaccagatcccgcagtacgccagcgacatgctggccctgctggcgcaactgcagcaaagcggcccgatcagcacgctggactgggtgggcaccagcatgggggggctgatcggcctggtcatcgccggccagccggggctgccgttgccggtgccggtgcgccgactggtgctcaacgatgtaggcccggtgattcagtggcaggcattgcagcgcattgcacagtacctgggccggtgggggcagttcgattcgttgcagcaggccgccgacgcgctgtggagcgtttccagcagtttcgggccgcacacgcccgcgcagtggctggagctgtcgcgcgccatggtgcggcccctgccgcaaggcgggttggcactgcactacgacccggcgattgccgtgccattcaggtccgcgtactccacgccagagtctgtcactgcgggcgaggccgccctgtggcgcttgtacgatcagatcacggcccgcacgctgctgctgcgcggcgtgcagtccgacctgctcgcgccagcgacggcgcaggcgatggccgggcgcggaccccgggcgcatgtcgtcgagttcgaaggcgtggggcatgcccccatgctgatggcggccgatcaactcgccgccgtcacgcagttcctgctggcgcaatga

SEQ ID NO: 6745 - DNA, 891 bp, Methylibium petroleiphilum PM1
atgaccgaaccgcgactcgactttgttccgtgcctggacacccagggcctgcaccgcatggcctattgggagtggggcgaacgcgacaatccgcgggtcgtcgtctgcgtgcacggcctcacgcgccaggggcgcgacttcgacaccctggcccgggcgctggcggccgattaccgcgttgtctgccccgacgtggcgggccgcggccgttccgactggctggccgatccggcgggctaccaggtgcccgcctacgtggccgacatggtggcgctgctggcgcgcatcggcgcgccgcaggtcgactgggtcggcacctcgatgggcggcctgatcggcctgggcgtggcctcgctgcgcgacggcgccggcggcacgctggtgcgccgcctgctgctcaacgacgtggggccggcgctgggcgccgacgcgatccagcgcatcggcacctatgtcgggctgcccaagcgctatgccagcctcgatgaggccgccgactacctgtggagcatctccaagggcttcgggccgcacagccgcgagcagtggctggcactgacgaagccacagctcaagccggtgcaggacgcgcagggcgagggcttcgtttcgcattacgacccgcgcatcggcctgccgttcaaggccgtcacgccggcgctggcggcggccggcgaagcgatgctgtggcagcgctacgacagcttgcgctgcccgacgctggtgctgcgtggtgccgagtccgacctgctctcgcacgagaccgcactggcgatgacgcagcggggaccgaaggcgcgcctggtggagctggccggcgtcgggcacgcgcccacgctggtggccgccgaccaggtggcactggtgcaggagttcctcgcctcgccatga

SEQ ID NO: 6746 - DNA, 1881 bp, Polynucleobacter necessarius asymbioticus QLW P1DMWA 1
atgtcgggttcccatcatttccattcgcattcaaaaccaataaagcctcatagtcaatctggggtagatccttctttgcatgcccataaaaagggtgatgctcggcattcccacaccaaacaagtctctaatcagaatttaattcttattgcacttgtcctgacattaggattttcaggtgttgaaggtgccgccgcttattttgctaattcattggcgttgatctctgatgccggtcatatggtgacggatgctgctgccttaggtctagcacttctagcgcaaattattgctcgtcgtccaccatcaccaaggcattcatttgggtttggtagagcagaagcattagcggcatttgttaacagtattgcaatgctcgcattggtactgtggattgtgattgaagcgattagtcgttttgctaatccgcacaaggtcgatggcttaaccgtcaccgttgtagctgcgattggcctcttgatgaatgttgtagtggcatgggtcctttcacgcgacacgaagagtgtgaatactcgtgcagctctagtccatgtcatgggcgacttattaggatcagtggcggcgttgatagctggtattgttattcagctcactggctggatgccaattgatgcgattctttccatcttggtttcacttctcatccttaaatcgactatctcgatcttgcatgagtcttatcacttcctcatggagggtgtgcctttgcacattgattacttggcagtcggtcgagatttaaaagcagttcccggagttttggcggttcatgatttacatgtctgggagatgacccctagctttcccgcactcattgggcacattgaaattagcgacatgcaagagtggccatccattatggctaagatcaatgccatgctgttagataaacatggaattgatcacgttactttgcaacctgaagaggttggccaagacgaacatgatcatgagcatgacgatcatggtcttaatacagaagaaaaaccaactacttttctccatcagggtgataccttttatgttcagtgctcttcaggtgagtctgagcatcgcatggcttaccacgtatggggcgaccctactaatccaaaggtattgctttgcgtacacggcttaactcgtcgcggtagtgatttcaaaacattggcacaggcaatgtgtaaagactattacgtagtgtgtcccgatatcgtgggcaggggtgagtctgatcgcttaagcaacccaatgctatatgcggtgcctcagtatgtggctaacatagcccaacttattaaaaaacttggggtttctcaagtcgattggttgggcacttcgatgggtggattaattggtatggtttacgccgctatgccaaattgtccaattcaaaagatgctgatcaatgatgttggccctaggattgaacctgaagcattaaagcgcttaggttcttatgttggccaacccttcgtttttgggaatcgtgctgatgcattagagcgcctcaataagatatgcgcgtcatttggcgagcatacccctcaagagtgggagatttataacggaccaatgttgattcaaaaggatgagcagtggatcatgcactacgatcccaatatctccgtaccctttgcctcagtgaatcctattatggccaaggcgggggagatggcgatgtggcatgcctttaaacaaattcgcattccaatgttgatcgttcgcgggggtgactctgatttgctatctgcagctacggttgccgaaatgtgcaaaataaatccctatgcaagaagtattgaaatcccacatgttggccatgcgcctgcattcgttaaaccagaacagattgctttagcaaaagaatttttcagttaa

SEQ ID NO: 6747 - DNA, 1008 bp, Delftia acidovorans SPH-1
atgaatcatcctacgctgaactacgtatcctgcccggcagttgccgggcgtgcctcaccctggagccgtactgccagcccggctgctcaagataatgcgtcgcaccgcatggcctattgggaatggaatcgcaccggcgatccgaaccatccccatgtcgtggtctgcgtgcacggcctgtcgcgccaggggcgtgacttcgacgtgctggccgagcggctcagcgaacgcgcccgcgtgatctgccccgacgtggtcgggcgtggcgaaagcgactggctgcaggatccggccgcctaccaggtgcctctttacgcagccgacatgctggccttgctggcccaggtgcatgcgcaggcgcctgtcgaacaattggattgggtgggcaccagcatgggcgggctgatcggcatggcgcttgcgggccagccgggcctgccattgccggtgcccatccgcaggctggtgctcaacgatgtggggcctgtcatcgagtggtctgccctggagcgcatagggcagtacctgggcaagggcgtgcattttgaaaatcttgaacaggcagcccatgcgctgctcttgatttccgaaggcttcggcccacatagcgaagggcaatggttgcgattgacgcgacctatgatgcgcccggccgccgatggcggccttgtcttgcattacgacccgcagattgcagtgcccatgcagcagatgacgcccgagatggcccaggccggcgaagcgctgctgtggcagttgtatgaccagatcaaggcacgcgtcttgctagttcgtggtgcgcagtccgatctgctgactgcggccacggcgcaggccatggcgcagcgcggcccgaaggcgcattgcgtggaatttgaaggggtggggcatgcgcccaccttcgtcgcagcagggcaggtggccttgctgtgccggttcttatggggagaagagcgcttgccaagcaccatgaatcttgccgagcaggccagggagagtgacgaatga

SEQ ID NO: 6748 - DNA, 903 bp, Leptothrix cholodnii SP 6
atgcacgaaccgcgccttcaccacgtctcctgcctcgactcccagggcctgcaccgcatggcgtattgggagtggggcgactccgacaacccgcaggtggtggtgtgcgtgcatggcctgtcgcgccaggggcgtgacttcgacaccctggcgcgcgcgctcgcgccgcaatggcgggtgatctgtccggacgtggtcggccgcggccagtccgactggctgcccgatccgatgggctaccaggtgccggcctacgtggccgacatggtgacgctgatcgcgcgcctgaacgtgcccaaggtggcgtgggtcggcacctcgatgggcgggctgatcggcctgggtctcgccggcctgcgcaacagcccggtctcgcgcctggtgctcaacgacgtcgggccggtgatcgaatacgcctcgctgcagcgcatcggcacctacctcggtgcgccggtgcggtttgccgacgaggtcaaggcggcggcgttcctgcgcagcatctcggcgagtttcggcccgcacagcgacgagcagtggctggcgctcagccgtccgcaactcaagcgcgcacccgaaggcgacctgatcccgcactacgacccggccatcgcgctgccgttccgcgccgtcacgcccgagctggcactggccggccaggccttgctgtggaacagctatgaccgcgttcaggtgccgaccctgctgctgcgcggggccgaatccgatctgctgtcgcgcgagaccgccgtggcgatgacccggcgcggtccgcatgcgcggctggtcgagttcgacggcgtgggccatgcgccgacgctggtcgcgcccgatcaggtcgaatgcgtgcgcggcttcctggccgaagggctggtgacggcgcccgaagcagcggttcccgcctga

SEQ ID NO: 6749 - DNA, 1824 bp, Polynucleobacter necessarius STIR1
atgaattctggtgttgatccttcgcttcatgctcataaaaagggcgatgcaaagcacacccatagcaaacaagtctccaatcaaaatttactgttaatcgccttagttcttactttagccttttcaggcattgaaggtgcagcagcatactttgctaactcattagcactaatctccgatgctggccatatggtcacagatgctgcagctttaggattggctttgttggcgcaaattatttcccgtcgtccaccatctccaaagcattcatttggctttggtcgtgctgaggcgcttgctgcatttgtaaatagtattgtgatgctagttttagttgtttggatcatggtcgaggcaattagccgcttctatgacccgcataaggtcgatggcttcaccgttactgttgtggcagcagttggcttgctgatgaacatcgttgtggcgtgggtgttatcacgcaataagaagagtgtgaatacccgcgcagctttagtgcatgtcatgggtgatttactgggatcaatcgctgcattgattgctggtgttgttattcagttaacaggatggatgccaatcgatgccattctctcaatcttggtatctctgctgattctcaagtctacaatctcaatacttcacgagtcctatcacttcttgatggaaggcgtgccacttcatattaattatttggaagttggaactgatctgaagaatgtgcctggcgtattggctgttcacgacctacatgtgtgggagatgacaccaagctttccagcgctcattggccatattgaaatagttgatatgcaagagtggccgcagatcatgtctcgtattaatgcgatgcttttagataagtacggcattgatcatgtgactttgcaaccagaagaggttggcgaagatcgcgaccatgatcatgcaggccatgatttacacaacgatacacagacagctaacgtgtttcatgacggtgaaactttttatgtggactgcgctagtggcgatgaaaaataccgcatggcctatcacgcttggggaaacccaagtaataaagtgttgctttgtgttcatggcctcactcgacggggtagtgactttaagacgcttgctcaggcaatgtgcaatgactattacgtagtctgcccagatgtggtgggaagaggggattctgatcgtcttagtaatccaatgctgtatgccgtacctcagtatgtgtctgatattgcaaccttagtgaaaaagctcggtgtttcacaagtggattggtttggcacatcgatgggcggtctcattggtatggtctatgccgccatgctgaattcacctatccgccgcatgttgattaatgatgtaggtccgcgtatcgaacctgaggcaattaagcgtttaggatcttacgtaggtcagccatttgcctttagcagtcgggctgatgcactcaatcgtttgaatgaaatttgcgccagttttggcgagcacactgcgcaagagtgggaaatctataacggccccatgttagttcagaaggagggaaaatggatcatgcattacgatccagatatttcagtgccgttcgcttctgtaaacccaatcatggctaaggccggtgaaatggcgatgtggcacgctttcaagcaaattcatattccaatgctgattgttcgtggcggtaattctgatttgttatctgcagcaactgtagcagaaatgtgcaaagtaaatccttatgcacgcagtatagagatcccaaatgtagggcatgctcctgcatttgtgaagtcagaacaaatcgcattggcgaaagaattttttagttaa

SEQ ID NO: 6750 - DNA, 936 bp, Diaphorobacter TPSY uid29975
atgattcaacctacgctgaaatacgtaccgtgccccggccccgcggccgccggccacccggagcaaggccatcgcatggcctactgggagtggaacgagacgggcgacgcggcccatccccatgtgatcatctgcgtccacgggctggcacgccaggggcgggacttcgacaccctggcacgcgcgctggcccgccatgcgcgcgtggtctgccccgatgtcgtggggcgcggacgcagccattggctggccgatccgatgcaataccaattgccggtgtacgcggccgacatgcgggccttgctggtccagctgcatagccagggccccatcgccaccctggattgggtgggcacgagcatgggcgggctcatcggcacgggcctgtgcggccagccgggagtgttgccggtacccgtgcggcgcctggtgctcaacgatgtgggaccgcgggtggagtggcaagcgctcgcgcgcatcggccagtacctgggccagcccgcgcatttcgcgacgctgcagcaggcggccgacgcgctgtgggcggtgtcgcgcagcttcgggccgcacacgcctgcgcagtggctggaactgtctcgcgccatggtgcgcgagacgccccaagggggcttggccctgcactacgacccggcgatcgccgtgccctttcgcgccctcacgcccgaggccgcgctggcgggtgagcagcagctatggcagctgtacgaccagatcccggcccaggtgctgctgctgcgcggtgcggagtcggacctgctgtccagcgccacggcgcgcgagatgaccgcgcgcggcccgcgtgcgcggctggtggagttcgccggcgtgggccacgcgccgacgctggtgcagccggaccaggtggccgtggtcgcgcagttcctgctggagcggcaggaggagttgacagcatga

SEQ ID NO: 6751 - DNA, 960 bp, Variovorax paradoxus S110
atgacagaaccgacgcttcattacgtggcgtgcgatgacgcccagggcggtcaccgcatggcctactggcaatggggcgacgcgcgcagtgcgcgcgtggtggtctgcgtgcacggcctcacgcggcagggacgcgacttcgacgtgctcgccgaggccctcgtggcacgcgccgccggcgacgtgcgcgtggtctgccccgacgtggcggggcgcggccagagcgactggctgcgcgacccggccctctaccaggtgccggtctatgcggccgacatgctggcgctggttgcgcagctgcaccgcgaacgaccgatcaacacgctcgactacctgggcaccagcatgggcgggctgatcggcttcgtgctggcggggcacaagcagctgccgctggcccggccgatccgccgcttcgtcgtgaacgacgtgggcccgacgatcgaggccgccgcgctgcagcgcattggcgcctacgtggggcagggcggccgctacgacagcgtgcaatcggcggccgatgccatgtggacgatctcgaccagcttcggcccccatacaccggaccagtggctttcgctgtcgcagcacatggtggtgcctgcgtcgcagcgcacgcccgatggcgccggcaaggtggaggccagcgaatcccatggcgacgcagccggtccctggctgcttcactacgacccggccattgccgttgcgctgcgcgccatcacgcccgaggctgcggtccagggcggtgccgtgatgtggagcctctacgacgccatcgatgcgcgcacgctcgtgacgcgcggcgcgcagtcggacctgctctcgcgcgaaacggccctggccatgacgcagcgcggtccgcgcgcggcgctggtcgagttcgaaggcgtgggccatgcgcccaccttcgtcgaccccgtgcaggtgggcgccgtcaccaacttcctgttcgattga

SEQ ID NO: 6752 - DNA, 1140 bp, Dechloromonas aromatica RCB
atgtcccccctcctgcccaaacaaagcatcctggtcgtcgacgacagccccgagaatatcgacttgctgagtgaagtgctgcgcgacgaatatcgcatccgcgttgccacctctggcgaaaaggcactgaaaattgtctactcggatgagccgccggacctgatcctgctcgacatcatgatgccggggctcagcggactggagatctgccgacgcctgaaggccaatccggaccgccggcggattccggtcattttcgttacggccatgagcagcatggatgacgaaaagcggggtctggaaaccggtgccgtcgactacatcaccaagccaatcagcccgcccatcgtcaaggcgcgcgtccgcacccaccttgccctctacgaccagtcgcgcgaactcgaacacatggtgcagcaacgcacccacgaattgctgaccactcgccaacaaatcatccgccgcctgggtcgggcggccgagttcaaggacaacgaaaccggcaaccacgtcctgcgcatgagccactacgcccgactgatcgcgcatgcgcacggcctgggtgaagaagcctccaatgtcattttcaacaccgccccgatgcacgacatcggcaagatcggtattccagattccatcctgctcaagccggccaagctggatgccgaggaatggaaagtgatgtaccagcacccgatcatgggggccgaaatcatcggcaagcacgataacgaactgctggaaaccgcaaggatcatcgccctgacccatcacgaaaaatgggatggcaccggctacccgcaaggcctcaagggcgaggccatcccgctcgaaggccgcatcgttgccattgccgacgtcttcgatgccctcgtttccgtccgcccctacaaagcagccgttccactcaatgaagcgatgcaatatctggaatcccaaagcggccttcatttcgaccccagcctgatggatgctttccgaaaagccctgcctgaaatcctccgcatcaaggaaatctacgccgacgaaaacggcgccctgaccgatctggaattccacatcaaggaaatctacgatcacaaggacgatccgcaaggctatccggaaaatctggccagtacgaatggtggtttcgagtaa

SEQ ID NO: 6753 - DNA, 909 bp, Nitrosospira multiformis ATCC 25196
atgaagatactcattgccgaagacgacacgacctcgcgcctgttgtttgccgccaccctcaggaaactgggtcataccgtaacggcagtagaggatgggcgtaaggcatgggaagcctggcaaaaggatgaatatccgctgctcatctccgactggatgatgcctgatatcgatggtctgcaattatgcagaatgattcgcggcgaaccgggcctgcaatatacctacatcatccttcttactgcgctggacagcaagggcagctatctcgaaggcatggacgcaggggcagatgatttcattactaaaccgttcgatgaagaacagctggcagcccggctacgggtggctgaacgaatacttggcctgcatcaaaagctacatatccaggccacgcgggattatttgaccggcgtatggaaccgagcctccatcatggattatctgcagaaggagttgaagcgaggagcgcggcaggatatctgcacgagtgtgatgatagcggatctcgatcacttcaagcgaatcaacgatacctatgggcatccgaccggtgatgaaatactgcaagaggcagcccgccgtatgtcaggtgtattacggggttatgaccgggtcggacgctatggaggcgaggaatttctcattacggcatcgggttgtgactggagcgaggccctggccctgggcgaaagaatctgtagctccatcaggagcgagcctgccaacagccgtgcgggacaaattgacatgactgtgagcataggtatcgcgacgagttgcggacaggttaatgatatcggtgagcttatcgcagccgccgatcaagcgctctatcaagcaaaagaggctgggcgtaatcaagttaaattgtcgcggttgccgatcgaatcaggacccgcgccatag

SEQ ID NO: 6754 - DNA, 1023 bp, Shewanella amazonensis SB2B
atggaaaaggccacagtgctggtggtggatgatacccctgagaacatcgatattctggtggggatcttggggcaggattataaggtcaaggttgccatcgatggccctcgggcgctggcgctggcgctgaagtcgccaccggatctgattttactggatgtgatgatgccggggatgagtggctatgaggtatgtcgccgtctcaagcaggagcccatgacggcccatatcccggtgatcttcgttaccgcccttgccgaggtcgccgacgaaacccagggttttgagttgggggccgtggactatattaccaagcccgtgagcgcgcccattgtgaaggtgagggtgaaaacccacctggcactttacgaccagaaaagactgctcgaagagcaggtgcgggaacggaccaaagagctcgaacagacccgttttgagattatccgccgtctcggccgcgccgccgaatacaaggacaacgaaaccgggttgcacgtggttcgcatgagccattacgcaagattgctggcccgacaggcggggttgcctgaacccttctgtgagctcctgtacaatgccgcgcccatgcatgatatcggcaaaataggcacgcccgatgcggtgctgaaaaagcccgccaaactggatgccgaagagtgggaaatcatgcagcagcacgccagcataggggccgaaatcattggcgaacatccggatccactgctgcagatgtcccgccgcattgctctgactcaccatgaaaaatgggacggttcaggctatcccaatggtctcagcggcactgaaatccccatcgaggggcgtattgtggccatcgccgatgtgttcgatgccctgacctccatcaggccatacaagaaggcatggagtattgaagacaccatggccttgctggagtcggaagccggcaagcagttcgaccccgagctggttgatcacttcaagcagatattgcccgaggtggttgccgtgcgggataagcacatggaaaccgaaggctag

SEQ ID NO: 6755 - DNA, 927 bp, Halorhodospira halophila SL1
atgatgcacgaagaccccctgccgcagtggccgacgatcctcatcgtcgacgacgagcccaccaacatccaggccctggcccacctgctcaaggacgattaccacatccgggtggccacggggggcgccaaggcgctggagatcgccgccgggacaccgcaaccggacctgatcctgctcgatgtggtcatgcccgagcccgacggctacgagatctgccgccggctcaaggccgaccgggccacccagaacatcccggtgatcttcgtaacaggaagggacagcgccgccgatgaggagcacgggctggaactcggcgccatggactacatcaccaagcccttcagcccgcggatcacacgaacccgcgtgcgcaaccacgtcgaccttaagcgcaagaccgacgccctggagcggctctcgcagcgcgacgggctgaccgacctgcccaatcgccgggtcctggaccggcaactgccggaggagtggagccggtgccagcgcggtgacacgccgttatcggtcatcatgatggatatcgaccacttcaagccgtacaacgaccactacggccacggcgccggggatgagtgcctgcgccgcgtcgcccgtgtgcttgcgaatgtgccgagccggaccacggacctggtggcccgctacggcggcgaggagttcatcgccctgctgccctataccgatgcccccgatgcctggcagatggccgagcggttccgcgcggcggtcgccgcgctgcaactcccccacggacactcttcgaccgacggcatcatcaccatgagcgtcggcgttgcgagccatacggccgatcgcccctacgacagccccgagcagctcctggaggccgccgatcaggcgctctacgccgctaagaaggcgggccgcaaccgggtccaggcggcgcaatga

SEQ ID NO: 6756 - DNA, 1032 bp, Shewanella woodyi ATCC 51908
gtggataagagtatggttgagaaggcgacagtgctggtggttgatgatacgccggaaaatatcgatgtgttagcaggtgttttacgcgacctttataaagtcaaagtggcaagaaatggtgagatcgcgctgaaaattacccgctcgccttcgcctcctgatctgattttactggatgtgatgatggacggtattgatggttatgaggtgtgtcggcagttaaaggaggaccatagtactcgtcatatccctattatctttgttacagctaagatagctcaggaggatgaggtgaaaggttttgagctgggggctgtggattacatcagtaaacctatcagcccagccattgtgctttccagagtgaagacacacttagctctctataatcaaaaccgtgagcttgataggaaggtgctagagaagactcaagagatatctgataaccagttaaaagtggtgcaaaggctagggcgagctgccgagtataaagataacgaaactggaatgcatgttatccgcatgagccattacacctatgtactggctttagccaccggaatgagtgagaaagatgccgagacattaagagtggcagcgccaatgcatgatgtcggtaagataggtattccagattcgattttacaaaaacaggggaaactggatgaggatgagtggcaagtgatgctcacccatgcagagattggcgccgagatcttaggtgacgatagctccgagatgctcagtattgcgcgcactgttgctctatcacaccatgaaaaatgggatggctcaggttatccttatggattaaaaggtgaagctatccctatggtggggcgcatcgttgctattgcagacgtgtttgatgcactgactagcatccgtccctacaagcaggcatggagtgttgatgaagcgttggggctgcttaaagaggagtcgggccgacatttcgacccttccctggtgacgctttttatcgcatgtatcgatgatattttggagattaagagtaagtttcaaggttag

SEQ ID NO: 6757 - DNA, 1176 bp, Desulfovibrio vulgaris  Miyazaki F
atgaccgacactccccttcacgcagacgacacgcggcgcaccgtactggtggtggacgacaccgtcgacaacctgaccctgctcagcgacctgctgaaagacacctaccgggtcaaggtggccaacagcggagaaaaggccctgcgcatcctgtcatccggcagcccgccggacctcgtgctgctggacatcatgatgcccggcatggacggctacacggtgctgcgcaggctgaaggaactgcccggcacggcggacgtgccggtgatcttcctcaccgccctgtcggaagaggacgacgagcgcatcggcctggaactgggggccgtggattacatcaccaagccgatcagcccgtccatcatgctggcccgtgtgcgcacccacctgcaggtcaaggccgcccgcgactttctgaaggacaagaacgaattcctcgaggacgaggtggcccgccgcatgcgcgaactggccgccgtgcaggacgtgaccatcatggccatggcctcgctggcggaaacgcgcgacaacgagaccggcaaccacatccgccgcactcagcactacgtgaaggtgctggcccaacacctgtcggagcatccgcgcttttccgccgcgctcacgccagaggacatccccctgctgttcaagtccgccccgctgcacgacatcggcaaggtgggcattgccgaccgcatcctgctgaaacccggcaagctcacgccggaggaattcgaggacatgaagcgtcaccccgcgctggggcgcgacgccatcatcgcagcggaaaaacagctggatacgccggtatcgttcctgcgccacgcgcgcgagatcgcctactgccaccatgaaaagtgggacggcagcggctacccgcaaggcctttccggcgacgggattcccgtttcggcccggctcatggccctggccgacgtgttcgatgcgctgatcagccgccgtgtatacaaacccccgttcgacatggagaaatccgtggaaatcatccgccaggggcgcggctcgcacttcgacccggacgtggtggacgcctttctggccaacctgcaaacattccgggacatcgccgaccgctacaccgactcggaggaaacgctggaagaaacccgctcgcgcaccgaaaaggattacccgccctcgggcgcgcgagggtaa

SEQ ID NO: 6758 - DNA, 1200 bp, Thioalkalivibrio HL EbGR7
atggtctttatgaacgaacttcacagttctgatccccgcaaggctcaggtcatctccatggcgagagaggccgcccgtcggcgtacggcgccggcccagtggcgttccggccatgccgagggcgaaggcgagtacgagtacacgccgccggctgcccgcatgcgcctggtgatcgtggacgatcagtccaccggaaggcgcatcctgcgggagctgctccaggacgtgggtcagggggtggagatcgtcgactatgccgcgccccaggatgccctgctggatgtgcgcgagaacctgccggacctgatcgtcaccgactaccgcatgcccgggatgaacggcacccagttaatccgcgccgtgcgcgccctgcccggcggcgccgacgtgcccatcgtggtggtgaccgtgctcgaggaccgcaacgtgcgctacgaggccctggaggccggcgccacggatttcctgtcccgccccctggacccggtggaatgcagggtgcgctgccgcaacctgctgcaactgcgccgccaggggcgcctggtgcgcaagcgcgcccagtggctggagcagcgggtgctcgccgccacccaggaggtcatcaagcgggaacgggagaccctgttccgcctcgccaaggcgggggaataccgggacgagggcacgggtaaccacgtgctgcgcatggcccgctacgcccgctgcgtggccgaggccctgggcctggacgaggtgctgtgcgagaccatcgagctggccgcgccgatgcacgacatcggcaagatcggcgtgccggaccatatcctgctcaagcccggtgagctcaccccggacgagcgcgagatcatgatgcgccatgccagcatcggtcatcagatcctcatggaatccgattcgcgctacatccagatgggcgcggtgatcgccctgagccaccacgagcgctgggacggcgccggctatccccaggggctcgccggcgaggccatccccctgccggcgcgcatcgtcgccgtggccgatgtctatgacgccctgcgttccgaccgcccctacaagtccgcctggaaccgggatgcggcctgcgatttcctgcgtgacgaggccggcaggcgcttcgaccccaccgtggtggccgccttcctgagctgcttcgagcgtatctgccaggtcgaggacagcttgcgcgacacgacctag

SEQ ID NO: 6759 - DNA, 1044 bp, Azotobacter vinelandii DJ
atgaaagccaccatcctcgtcgtggacgacgtaccggagaacatcgacatcttcgtcgagatcctcgcgccgcatcaccgcaccaaggtcgccctgaacggcgagcgggcgctcaggatcgcccgctcggacaacccgccggacctcatcctgctcgatgtgatgatgccgggactgagcggctatcaggtctgcgaacggctcaaggccgatccggacacccgggccattccggtgatcttcgtcaccgccatgagcgaaacggccgacgagcagcgcggcctggagctgggcgcggtggactacatcaccaagccgatcagcccgccgatcgccctggcccgggtacggacccacctggcgctccatcggcagcgccaggaactggcccggcaggtcgagcagcgcaccgccgaactgctcaggacccgccagcagatcgtccgccgcctgagccgcgccgcggagtttcgcgacaacgagacgggcaaccacatcgtgcgcatgagccacatcgcccgactgatcgcccaggcagccggcatgggcgcggagttcgtggaaaccctgttcaatgccgcgccgatgcacgacatcggcaagatcggcattcccgacagcatcctgttcaagtcgggccggctggaaccggaagaatgggcgatcatgcgccggcataccgagatcggcgcgaagatcatcggccggcacgacgacgacctgctcaaggccgcccacagcatcgccctgcaccaccacgagaaatgggacggcagcggttacccccaaggcctcgggggcgaggagattcctttgatggcgcgcatcgccgccgtcgccgatgtgttcgacgccctgacctcggcgcgcccctacaagaaggcctggcccctggaggaggcggtcggctacatcgaggcccaggccggcacgcatttcgatccggcgctgatcggccccttccggcgctcgctcggggagatcgcgcggatcgtcgaacgctatgccgaccaccagggcccatgcctggacttcgacccgtag

SEQ ID NO: 6760 - DNA, 405 bp, Brucella suis 1330
atgcttgaacgcttgaaccatgtggcgatagccgttcccgatcttgaagccgcaaccgcgctttatcgcggtaagcttggcgccacggtcacagagccggaggctcggccggaacatggcgtaacggtggttttcatagacgtcggcaataccaagatcgaacttctggaacctctgggcgagggctcgccgattgctgcctttcttgagaagaacccttcgggcggcatgcatcatctgtgctatgaggttgccgatatcatcgccgcgcgcgatcgtctcaaggcggaaggcgcccgcattcttggcaatggcgagccgaagattggcgcgcatggcaagccggttctgtttttgcatcccaaggatttcaacggcacgctgatcgaactcgaagaggtctga

SEQ ID NO: 6761 - DNA, 405 bp, Nitrobacter winogradskyi Nb-255
atgctgggtcgactcaatcatgtggctatcgccgtcagggatgccgaaaaggcggcgaagatctacggcgccgccttcggcgcggagatttcagcccccctgccgttgcccgaacatggggtgatcaccgtgtttgcgattctgccgaatacgaagatcgagtttattcagccgctcggcgagacatctccgatcgcgaagtttgtcgagcgcaatgccgatggcggtattcaccatgtctgctatgaggttcctgacatcgtcgcgactcgtgatattctgattgcagagggtgcgcgcgttcttggtgacggcgagccgaagattggcgcgcacggcaagccggtgcttttcttccatccgaaagacttttccggcgcgcttgtcgagatcgagcaatcctga

SEQ ID NO: 6762 - DNA, 405 bp, Rhodopseudomonas palustris HaA2
atgctggggcggctgaatcacgtggcgatcgcggtgaaggatgcggagcaggcggcgaagatctacggcgccgccttccaggccgagatttccgaggcggtgccgctgccggaacacggcgtcatcaccgtgttcgtgacgctgcccaacaccaagatcgagttcatccagccgctcggcgaagcgtcgccgatcgccaagtttctcgatcgcaacgccgatggcggcatccatcacgtctgctacgaagtgccggacatcatcgcggcgcgcgacacgctgatcaaggaaggtgcgcgcgtgctcggcgacggccagcccaagatcggcgcgcacggcaagccggtgctgttcctgcatccgaaggatttctcgggcgcgctggtcgagatcgagcagtcgtaa

SEQ ID NO: 6763 - DNA, 405 bp, Rhodopseudomonas palustris BisB18
atgctgggacggctcaaccatgtggcgatcgcggtgaaggacgccgagaaggccgcgaaaatctatggcgcggcgttcggcgcggagatttccgcggcggtgccgctgcccgaccacggcgtcatcaccgtgttcgtgagcttgccgaacaccaaggtcgaattcctgcagccgctcggcgagagctcgccgatcgccaagttcctcgagcgcaacgccgacggcggcattcatcacctctgctacgaggtcgccgacatcatcgccacgcgcgacctattgatcggcgaaggcgcccgcgtgctcggcgacggcaccccgaagatcggcgcgcacggcaagccggtgctgttcctgcatccgaaggatttctccggcgcgctggtcgagatcgagcaggcctga

SEQ ID NO: 6764 - DNA, 405 bp, Rhodopseudomonas palustris BisB5
atgctgggccggctcaatcatgtggccatcgcggtgaaggatgcggagcaggcggcgaagatctacggcgctgctttcaacgcggagatttccgcggccgtgccgttgccggatcacggcgtcatcaccgtgttcgtgacgctgccgaacaccaagatcgaattcatccagccgctcggcgaggcgtcgccgatcgcgaagtttctggagcgaaacgccgacggcgggatccatcacgtctgctacgaagtgccggacatcatcgcggcgcgtgacacgctgatcaaggagggcgctagcgtgctcggcgacggccagccgaagatcggcgcgcacggcaagccggtgctgtttctgcatccgaaggatttctcgggcgcgctggtcgaaatcgagcagtcgtaa

SEQ ID NO: 6765 - DNA, 405 bp, Nitrobacter hamburgensis X14
atgctgggtcggctcaatcatgtggctatcgccgtcagggatgccgaaaaggcggcgaagatctacggcgccgccttcggcgcggatatttccgccgcggtgccgctgccggagcatggggtgatcaccgtgtttgcggcgctgccgaacaccaagatcgaattcatccagccgctcggcgaggcctctccaattgcgaagtttatcgagcgtaacgctgatggcggtattcatcatatctgctatgaggtgcctgacattgtcgccactcgtgatatcctgatagcggaaggcgctcgcgttctcggcgatggcgagccgaagattggtgcgcacggcaagccggtgcttttcttccatccgaaagacttttccggcgcgcttgtcgaaatcgagcaatcctga

SEQ ID NO: 6766 - DNA, 405 bp, Rhodospirillum rubrum ATCC 11170
atgatcggacgtcttaatcacgttgccatcgcggtccccgatctcgaggcggcctgcgccgtttatcgtgacgcgctgggggcgaccgtttcggcgccgctgccccagcccgatcatggcgtgaccgtggtcttcgtggaactgcccaataccaagatcgaactcctccatccgctgggggaggcctcgccgatcgccgccttccttagcaaaagtcccgccggcggcatccatcacatctgctacgaggtcgaggatatcctggccgcccgcgaccatatgaaggccgagggcaagcgggttcttggcgatggcgagccgcgccttggcgcccatggcaagccggtgctgttccttcatcccaaggacttcaacggcacgctggttgaactcgagcaggcctga

SEQ ID NO: 6767 - DNA, 405 bp, Mesorhizobium BNC1
atgctcaagcggctcaatcacgttgcgatcgctgtgcccgatcttgaggcagccgccgccacctatcgtgacgtgttgggcgccaccgtctcgccgccacaggccctgcctgagcacggggtcacggtcgtcttcgtcgaactcggcaacacgaaggtggagctgatcgagccgctgggcgaaaattcaccgatcgccggttttctcgagaagagcccggcgggcggcatgcaccacatatgctacgaagtggacgacatcatcgttgcccgcgatcggctggtggctggcggcgcccgtgtgttgggcgatggcgagccgaagacaggcgctcacggcaagccggtgctttttctgcatcccaaggacttttgcggcacgctcgtggagcttgaagaagtgtga

SEQ ID NO: 6768 - DNA, 420 bp, Maricaulis maris MCS10
atgaagatcggacgtttgaaccatgtcggcgtggccgttcccgatatcgaggcggccaaaaagacctatgccgcgctctatggcgcgacccaagcgaccgagaccaaggatttccctcatctgggtgtacgggtcgcctttgtccatctcgacaattccgagatcgaattgatcgagccgtgcggtgaggccagcccgatccacaaattcctcgagcgcaatcccaagggcggccagcaccatatctgttttgaagtgcccgacatcatcgctgcacgcgacgccatgcgcgagcgtggcgcgacagtgctgggtacgggcgaaccctatatcggcgcccattgcgtgccggtgatcttcgttcaccccaaggacagccatggccagctgatcgaattgatgcaggagccagcccgatga

SEQ ID NO: 6769 - DNA, 405 bp, Bradyrhizobium BTAi1
atgctgggccgtctcaatcacgtcgccatcgcggtcaaggacgcggagaaggccgccaagatctatggcgcggcgttcggtgccgagatctcgtcagccgtgccgctgccggagcacggcgtgatcaccgtgttcgtgaccttgccgaacaccaagatcgagttcatccagccgctcggcgaggcctcgccgatcgccaaattcctcgagcgcaatgcggacggcggcatccaccatgtctgctacgaggtggccgacatcatcgcctcgcgcgacacgctgatcaaggaaggcgcgcgcgtgctcggcgacggccagcccaagatcggcgcccatggcaagccggtgctgttcctgcatcccaaggatttttccggcgcgctcgttgaaatcgaacaggcctga

SEQ ID NO: 6770 - DNA, 405 bp, Brucella ovis
atgcttgaacgcttgaaccatgtggcgatagccgttcccgatcttgaagccgcaaccgcgctttatcgcggtaagcttggcgccacggtcacagagccggaggctctgccggaacatggcgtaacggtggttttcatagacgtcggcaataccaagatcgaacttctggaacctctgggcgagggctcgccgattgctgcctttcttgagaagaacccttcgggcggcatgcatcatctgtgctatgaggttgccgatatcatcgccgcgcgcgatcgtctcaaggcggaaggcgcccgcattcttggcaatggcgagccgaagattggcgcgcatggcaagccggttctgtttttgcatcccaaggatttcaacggcacgctgatcgaactcgaagaggtctga

SEQ ID NO: 6771 - DNA, 405 bp, Sinorhizobium medicae WSM419
atgttgggaaaagtgaaccacgtggcaatcgcggtgccggatctttcagccgcagtcgagagctatcgctccaccctcggagcattggtcaccgagccgcaggccttgcctgagcacggcgtaacggttgtcttcgtggcattgcccaacaccaaggttgaattgctcgagccgctcggagacgcatcgcccgtctccgctttcctggagaaaaacccggccggcggcatgcaccacatctgctatgaagtggaggacatcatcgccgcacgagaccggctgaaggacgccggggcccgtatcctcggtgacggaaatcccaagatcggtgcgcacggaaagccggttctgtttctccaccccaaggatttccagggcaccctgatcgagctcgaacaggtgtga

SEQ ID NO: 6772 - DNA, 405 bp, Ochrobactrum anthropi ATCC 49188
atgctcgaacgcttgaaccacgtggcgattgccgttccggatatcgatgccgcggcagcgctttatcgcggcaagctcggtgcgaaagtcaccgagccgcaggcactgcctgaacatggcgtaaccgtggttttcatcgacgtcggcaacaccaagatcgaattgctggaaccgttgggtgaggggtcgccgattgcggcgtttctggaaaagaatccttccggtgggatgcaccatctgtgctatgaggttgcggacataattgccgctcgcgaccgcctcaaggcggagggtgcgcgtatccttggagatggcgaaccgaagaccggcgcccatggcaagccagttctgttcctgcatcccaaggatttcaacggcacactgatcgaactggaagaggtgtaa

SEQ ID NO: 6773 - DNA, 405 bp, Parvibaculum lavamentivorans DS-1
atgctcggtcccctcaatcacgttgccatcgccgtgccggacgtgcgcgcggcgggcgagatgtaccgcacgaaatttgccgccaaggtctcggacgccgtgccgcagccagaccacggcgtgaccaccgttttcgtcgatctcggcaacaccaagatcgagctgctggagcccctgggtgagaattcgcccatcgccggcttcctcgccaagaatccgaagggcggcatccaccacatctgcatcgaggtcgaggatatcgacagcgcctgcgaaaaaatgaacaccgaaggcgtcacgatcaccggaacgggcaagccgcgcatcggcgcccatggcaagccggtcgtcttcctccacccgaaagacctttacggcacgctggtcgagctggaacaggcataa

SEQ ID NO: 6774 - DNA, 405 bp, Xanthobacter autotrophicus Py2
atgatcggacgcctgaaccatgtggccatcgcggtgcgcgacatcgccgccgcctccgcgctgtatcgggacacgctgggcgcggatgtctcggccgccgtgccgcagccagagcatggcgtgaccacggtgttcgtcaccctgcccaacaccaagatcgagttcctggagccgctgggagagaattcccccatcgccaagttcctggagcgcaatccggacggtggcatccaccacatctgctacgaggtggatgacatcctcaccgcccgcgaccagctgaaggcaacgggcgcccgcgtgctcggctccggtgatcccaagatcggcgcccatggcaagccggtgctgttcctgcaccccaaggacttcaacggaaccctggtggagctggagcaggcctga

SEQ ID NO: 6775 - DNA, 405 bp, Methylobacterium extorquens PA1
atgatcggacggctcaatcacgtcgccatcgcggtgaaggatctcgatgcggcgacggcggtctaccgcgacacgctcggcgccaaggtgaccgagccgctgccgcagccggagcacggcgtgacggtggtgttcgtggaactgcccaacagcaaggtcgagctgatgtcgccgctcggtgaaaactcgaccatccagggcttcgtcgacaagaacccggccggtggcatccaccatgtctgctacgaggtcgaggacatcatcgccgcccgcgaccagatgaaggcggccggagcccgcgtgctcggcaccggcgagccgaggatcggcgcccatggcaagccggtgatcttcctccaccccaaggacttcctgggaacgttggtggagctggagcaggtctga

SEQ ID NO: 6776 - DNA, 405 bp, Methylobacterium radiotolerans JCM 2831
atgatcggccgtctcaaccacgtggccatcgccgtgcaggatctcgacgccgcctgcgcggtctatcgcgacacgctgggtgcgaagatcaccgcgcccctgccgcagcccgagcacggcgtcaccgtcgtgttcgtcgagctgccgaacagcaagatcgagctgatggcccccctgggcgagggctcgccgatcgagtccttcgtggcccgcaacccgggcggcggcatccatcacgtctgctacgaggtcgacgacatcctggccgcccgcgacaagctcaaggcgcagggcgcccgggtgctcggcaccggcgagccgcggatcggcgcccacggcaagccggtcctgttcctgcatcccaaggacttcctgggcaccctggtcgagctggagcaggtgtga

SEQ ID NO: 6777 - DNA, 405 bp, Methylobacterium populi BJ001
atgatcggacggctcaaccacgtcgccatcgcggtgaaggatctcgacgcggcgaccgcaatctaccgcgacacgctgggcgccaaggtgaccgagccgctgccgcagccggagcacggcgtgacggtggtgttcgtggaactgcccaacagcaaggtcgagctgatgtcgcccctgggcgagaactcgaccatccagggcttcgtcgacaagaatccggccggcggcatccaccacgtctgctacgaggtcgaggacatcatcgccgcccgcgacaagatgaaggcggccggcgcccgcgtgctcggcaccggcgagccgaagatcggcgcccatggcaagccggtgatcttcctccaccccaaggacttcctcgggacgctggtggagctggagcaggtctga

SEQ ID NO: 6778 - DNA, 405 bp, Rhodopseudomonas palustris TIE 1
atgctcgggcggctcaaccacgtggcgatcgcggtgaaggatgcggtgcaggccgccaaggtctacggcgccggcttcgacgcggcgatctcggaagcggtgccgctgccggaacacggcgtcatcaccgtgttcgtgaccctgccgaacaccaagatcgagttcatccagccgctcggcgaagcctcgccgatcgccaagtttctcgagcgcaacgccgacggcggcattcaccacgtctgctacgaagtgccggacatcatcgaagcgcgcgaccgcctgaccaaggaaggcgcgcgggtgctcggcgacggcaatccgaagatcggcgcgcacggcaagccggtgctgttcttccatccgaaggatttctccggcgcgttggtcgagatcgaacaagcctga

SEQ ID NO: 6779 - DNA, 405 bp, Methylobacterium sp. 4-46
atgatcggccggttgaatcacgtcgccatcgcggtgaaggacctcgacgccgccgcgaaggtctaccgcgacacgctcggcgcggcgctgtcgccgcccctcgcgcagccggagcacggcgtcacggtcatcttcgtcgagttgcccaacagcaagatcgagctgctcgaaccgctcggggccgactcgccgatcgccgccttcctggagcgcaacccgggcggcggcatccaccacgtctgctacgaggtcgacgatatcctggcggcccgggaccggctgaagggcgagggggcccgcatcctcggcagcggcgagccgcgcatcggcgcgcacggcaagccggtgctgttcctgcacccgaaggacttcctcgggacgctggtcgagctggagcaggcctga

SEQ ID NO: 6780 - DNA, 405 bp, Rhizobium leguminosarum bv  trifolii WSM2304
atgcttggccgggtaaaccacatcgccatcgccgttcccgatctggcagcggcgaccgccgcctatcgcgacacgctgggtgctgccgtatcgcagccgcaggctctgccggagcacggcgttactgtggtcttcgtcgaattgccgaataccaaggtggaattgctgcagccgcttggggaaacctcgccgatcgcaaccttcctggaaaagaacccgtccggcggcatgcaccacatctgttatgaggtggacgatatcctgcttgcgcgtgaccggctggtcgcggccggggcgagggtgctcggtgacggccagccgaagaccggcgcgcatggcaagccggtgcttttcctgcaccccaaggatttcttcggcacgctgatcgaactcgaacaggcgtga

SEQ ID NO: 6781 - DNA, 405 bp, Methylocella silvestris BL2
atgatcggacggttgaaccatgtcgcgatcgcggtgaaggagctcgccccggcggcggcgcaatatcgcaacgcgcttggcgccaaggtgagcgaacccgagcccttgcccgaccatggcgtcaccgtggtcttcatcacgctggacaacgccaagatcgagctgctcgagccgctcggggaagcctcgccaatcgccgatttcgtcgcccgaaaccccaagggcgccattcaccacatttgctatgaggtggatgatattgtcgccgccagagaccgattgcacgcaagcggcgcgcgcgtgctcggcggcggcgagccgaaaatcggcgcgcatggcaagccggtgctgtttcttcatcccggcgatttctctggaactttgatagaactcgagcaggcttga

SEQ ID NO: 6782 - DNA, 405 bp, Methylobacterium chloromethanicum CM4
atgatcggacggctcaatcacgtcgccatcgcggtgaaggatctcgatgcggcgacggcggtctaccgcgacacgctcggcgccaaggtgaccgagccgctgccgcagccggagcacggcgtgacggtggtgttcgtggaactgcccaacagcaaggtcgagctgatgtcgccgctcggcgagaactcgaccatccagggcttcgtcgacaagaacccggccggcggcatccatcacgtctgctacgaggtcgaggacatcatcgccgcccgcgaccagatgaaggcggccggagcccgcgtgctcggcaccggcgagccgaggatcggcgcccatggcaagccggtgatcttcctccaccccaaggacttcctgggaacgctggtggagctggagcaggtctga

SEQ ID NO: 6783 - DNA, 405 bp, Methylobacterium nodulans ORS 2060
atgatcggccggttgaatcacgtcgccatcgcggtgaaggacctggaggccgccgcgaagatctatcgcgacaccctcggcgcgacgctgtcgccgccgctggcccagcccgagcacggcgtcacggtcatcttcgtcgaattgcccaacagcaagatcgagctcctggagcccctcggcgccgattccccgatcgcgtccttcctggagcgcaacccgggcggcggcatccaccatgtctgctacgaggtggacgacatcctggctgcccgcgatcgcctgaagggggagggcgcccggatcctgggcagcggtgaaccccgcatcggcgcgcatggcaagccggtgctgttcctgcacccgaaggacttcctcggcaccctcgtcgagctggaacaggcctga

SEQ ID NO: 6784 - DNA, 405 bp, Agrobacterium vitis S4
ttgctgggtcgggtcaatcatatcgccatcgccgtgccagatcttagctctgccgttgagacttacgctgacacgcttggcgcgacggtttccgaagctcaagccttgccggagcatggtgtgacggtggtttttgtcgaactcccaaataccaaggtcgaactgctggcgccgctgggcgatcattctccgatcaaggcctttctcgagaaatcgcccaatggtggcatgcaccacatttgctacgaggtggatgatatttacgctgcgcgggaccgcctgatctccaaaggtgcccgcgttttgggagatggtgagccgaaaatcggcgcgcatggcaagccggtggtttttctgcatcccaaggattttaatgggacattgatcgaactcgagcaactttag

SEQ ID NO: 6785 - DNA, 405 bp, Rhizobium leguminosarum bv  trifolii WSM1325
atgctcggccgggtcaaccatatcgccatcgccgtgcccgatctggccgcggcgacggccgcctatcgcgatacgctgggcgctgccgtatcgcagccgcagactctgccggaacacggcgtcaccgtcgtcttcgtcgaattgccgaacaccaaggtcgaattgctgcaaccgttcggcgatacttcgccgatcgcagccttcctcgaaaagaacccatccggtggcatgcaccacatctgctacgaggtggacgatatccttcttgcccgtgaccggctggtcgcggcgggcgcaagggtgcttggcgatggccagccgaagatcggcgcgcatggcaagccggtactctttctgcaccccaaggatttcttcggcacgctgatcgaactcgaacaggcctga

SEQ ID NO: 6786 - DNA, 513 bp, Prochlorococcus marinus NATL2A
atgaaaattccaaaatatattgaattccataaccgaacaaattctgttctctctagatttttaaaggcggcagagcctgaggaaggctgctgtattctaatcggcaaaacaaacagcttaactaaagatcacaaaagaaatatttgggaggtaactcacgtatggaattgtcaaaacatttggggtgaagaagaatcgagattaattgatcaaaatatagaagcggtttctaaccaaaaaaatttgcaattatccaaaaaaaattgcttcgaaatatacgctaaagatcaaattgcatctcagaaatgggcaagagagaatgatcttgaagttttatgttgtgctcactcacatcctttaaatgaaaacagaccctcagaaatggatctattattccaccaacctcctggtcttatggttatttcaaataaagatggagatttaaaagcatggtggattaaaaataaattaaaattccatagcgtgaaaattgaagttttttctttaacgtaa

SEQ ID NO: 6787 - DNA, 498 bp, Anabaena variabilis ATCC 29413
atgaatcaaccaactatcaaactcttaccacaacatcagcaaaccatcctcagtcatgctgaaagcgtctatccggaagagtgttgtgggttgattatgggatacgtagccaataaggcgaaaattgtagtggaagtcatacctaccgctaacgcttgggagacagaagcagataactttacccaagaaataaaccagacaaatatcacttccccagcctccaccttaaaaagaagatatgcgatcgcacctcaagttatgttacaggtacaaaggcaagcgcgggataagtcactcaatattattggtatctatcactctcaccctgatcatcatgccgtaccttcagaatgcgatcgcctctatgcttggcctggatactcgtatataatagtttccgtccaaaaaggtatagccagtggcatccttagttggagccttgatgatcatcatcagtttcaatcagaaataattgataacataactttaaatacttaa

SEQ ID NO: 6788 - DNA, 405 bp, Nitrosococcus oceani ATCC 19707
atggcagaagtcatacttccccgccccttggttaaccaactgctgcaccaggcacaggtaaagccccagcaggaaatatgcggactgatcagcgcccgtaacggtctcccttcccgctgctatcccatcaataatattgcgccggaaccacaacggcattttttcatggatccccagggccaaatcgcggccatgcgccgtatgcgcgaagagggtgaggaattatttggtatctatcattcccatcctgaaactgcgcctttgccctcaaaaagcgaccttgcccaagcggcttaccctggcgcattatatttaattatttccctcaatactaaaggcgtcctggagatgcgaggctttcggttgcaaggagaggtatacgaggagatcgagctacaattataa

SEQ ID NO: 6789 - DNA, 555 bp, Synechococcus sp. CC9902
atggggtcggtggaattcttaactcattcagccgagcgtatcggtggggagccgttcgcgccatcactcctgggtttggatctccaatgcctcactgttctcgagcgttcattgctggcggtgaagcctcaagaaggatgtggtttgctcctcggaacaggtctgcgaaccccacgcctgaggctcgtaactctttggcctgcctgcaatgcatggaaaaaatcagactgggtgaatgatgctctaggagatcttgagacccggtttgtgttggatcctcgtgaacaaattgcagcgcagcgttgggcccgggtgcatgggttggaggtcttgggtgtctgccattcccaccccaaaacggcaccagaaccgtcaacgcgggactgtgcttgggcggaacccaaccagctgatgttgattttgtctgggatgcgagagctgcgtgcctggtggttgggtgctgatcggcatcccctcgaaatcccgattgaggtctgggaaaatcacacctatgcagccaagtcatcccaccccaaatcagagcctgtcctctga

SEQ ID NO: 6790 - DNA, 453 bp, Synechococcus sp. CC9605
gtgctgcaaattgatcaccgatgccacacggatctgcgccgcattttgttggcgccccatcccgaagaaggctgtgccttgctgctgggacagcggacgaattcagggtgtttgagggtgaccacgacctggccgtgttgcaacgtctggggacggggggcgtcaggccagcggcccgttcacgaccgttgcagacggtttctggtggatccgagggagcagttggccgcccagcgatgggcccggaatcgccatcaatattgtttaggcgtggctcactcccatccagcatccgagcccgtgccctcgccccatgatcggcagtggggggaggcggagagtgtgatgctgattctgtctgcctcgcttggcctgcgggcctggtggctgcatggtgaccgcagcgtggatgaaatcccgattcagctctgggacactcacaaaaatgcatga

SEQ ID NO: 6791 - DNA, 399 bp, Geobacter metallireducens GS-15
atgctgacgattccccgcgcgatccacgcagagctcatcgctcatgcccaagccgacgcccccattgaggcgtgcggcatcctcggcggtattgacggcgccgtctcggccatcttccggatggccaacaccgaccagagcgacgagcacttcatgatggaccccaaggagcagttcgccgtggtgaaggagttgcggaaccgggggctggcgatgcttgccatctatcactcccacccggagaccccggcccggccgtcggaagaggatatccggctggcactcactcccggcgtttcctatgtcatcgcctccctggccggcgcggaacccgacgtgaaagcgttccgcattactgacggcgtggtggagcctgagcccatcgatatcgtggagtaa

SEQ ID NO: 6792 - DNA, 435 bp, Synechococcus elongatus PCC 7942
atgctgacgctgctcctgcccgcgacctgtcgtcacacgatcgccgttcatttacagcagtgctatccccaagaaggttgcggtttgctgttgggagtggacagacgagttgaacaggtttggcccgccaccaatgtctggcagcctgaggacaccgatgaggatcacgatcgctgcgatcgctatcaagttgatccccaagcactcctgcaagcccagcgctactgccgcgaccgccaatggcaaattctcggcatttatcattcgcatcccgaccatccggcggttccctcagaatgcgatcgccagcaggcttggcctgagtatgtttacctcatcgcctcagtcacgcaaggtaagattgaagactgtcgttgttggcacctgaacgaccaacgacagtttgaggcgatcgcgatcgccgagccgacctga

SEQ ID NO: 6793 - DNA, 480 bp, Nitrosospira multiformis ATCC 25196
atgtcaacatcatggaggataagaatcatgctgaccatacacgccaagctcgttgaagcaatgcttgctcaggcacataaagatcatccttttgaaatctgcggggtcattgccggtccggaaaaatcgaatcttcccctgcgcctcatcccgatgcgcaatgcagcccagtccgaaacatttttcaagttcgatccgcaagagcagctacaggtctggagagagatggaggcacgtggcgaagaacccatcgtgatttatcactcccatacccacactccagcctatccaagccgtaccgacgtgcaatacgcgtcccagccccaatcccattatgtcattgttccaaccgatcccgcatacggagaagaaatccgcagcttccgcattctcgatggaatggtcaccgaagagagaatcaggatgataaattcatataaggcggaatgggagttatcgatggaggcaatggtagcctag

SEQ ID NO: 6794 - DNA, 468 bp, Trichodesmium erythraeum IMS101
atgcccttaatactctcctcttcctactttcaaaaaattttgactcatgctgaaatatcttacccaaatgaatgctgtggtttactattaggtcagaaaaaccaagagacaaaaacagttattgaagtctggcctgctgaaaatgcctggcaaacagaagcagatgaatattggccagaacaaacagaatttacagaagaaaaaagatatgccatatccccagaactgatgctaaaaacaatgaagtccgcaagagaacgccacttatctattattggcatctatcattcccacccaaaccatgtagctatcccctcagaatttgaccgtacctatgcttggccagaatattcctatgttataatctcagtggaaaaaggccaagctattgactttctctgttggtctcttgatgataatcaccagtttcaaccagaaaaaattattaaaataaaagataagcaataa

SEQ ID NO: 6795 - DNA, 429 bp, Alkalilimnicola ehrlichei MLHE-1
atgatggcgccattgtccccacacgccctgaccctgcccgcccgcgagcgcgaccggctcgcgcggttgggcctggcgcgctggccggaggaggcctgtgggctcatgctgggctgtgacggtcgggtccggcggctggtgctctgccgcaatgtggcggcccgccgggcggaccgctacctggtccacgcccgcgatttcctgcgctgggaccgcgccgcccaccgcctgggcctggatatcctgggcgtctggcacacccacccggacggcggggcgcgaccctccgggaccgaccgtgagcaggcctggcgggggtggagctacctgatcgccgctgtggacgggcgtgcgatcaccgagttgcggagctggcgcctgcgtggcgatcatttcatcgaggaaacgttatgtctgaaaccagcgtaa

SEQ ID NO: 6796 - DNA, 504 bp, Prochlorococcus marinus MIT 9303
atgccagggctgctggagtttgatcgtaattgcctgatggttcttcgtcgcagcttattggctgtggcgccatttgagggatgtgctcttttattgggtgatcaagatgattctaatagtgatcaaggcggcagtatctggaatgttcggctgatttggccttgctgcaatgtatgggggccgggaatgttaagcctccctgaaggctcgaatgatccgaatcttggggttgagctgctgccatcacgcaagtgtcgctttgctttggatcctcgtgaacagttgcaggctcaacgctttgccagagagcacaattggcaggtgttgggcagtgcccattctcatcctggcggtgaggctgtgccgtccgtgatggatcatcgctgggccactgtgccgtcgttactggtgatcgtggctggttcaggcaatgtgcgcgcttggtggctgacaggagtgcaacctggcgagcagcatgaggttgcgcatttgggacagtggtaa

SEQ ID NO: 6797 - DNA, 513 bp, Prochlorococcus marinus NATL1A
atgaaaattccaaaatatattgaattccacaaccgaacgaattctgttctctctagatttttaaaggcggcagagccagaggaaggctgctgtattctaatcggcaaaacaaacagctcaactaaagatcacaaaagaaatatttgggaggtaactcacatatggaattgtcaaaacatttggggtgaagaagaatcgagattaattgatcaaaatatagaagcggtttctatccaaaaaaatatgaaattatccaaaaaaaattgcttcgaaatagacgctaaagatcaaattgcatctcacaaatgggcaagagagaatgatcttgaagttttatgttgtgctcactcacatcctttaaatgaaaacaaaccctcagaaatggatctactattccaccaacctcctggtcttatggttatttcaaataaagatggagatttaaaagcatggtggattaaaaataaattaaaattccatagcgtgaaaattgaagttttttctttaacgtaa

SEQ ID NO: 6798 - DNA, 420 bp, Clostridium thermocellum ATCC 27405
gtgattgtcatgacaaagcagcagtaccaagagatacttgaacattcccgcaatgctttgcccaatgaagcctgcgggcttttgggcggcaggatagagaatggtgtgaaatatgttgagaaagtgtatctgttgaggaacatagacgaaagcccggaacatttctccatgaacccaaaggagcagtttgcggcagtcaaagatatgagaaacaacggttgggagcttctgggcaactttcacagccatcccgcaacgccatcccgcccctcggaagaggacataaggcttgcctttgatccaaaggcaagttatttgatattatcactaaaggacgacacaccggtgctaaagagctttaatatttcatcaggacaggcaactcaggaagagttgtctattgtgggggaggaagcatag

SEQ ID NO: 6799 - DNA, 399 bp, Geobacter uraniumreducens Rf4
atgctgaaaatttccaaagcgatccacgacgacatcatcgcccacgcccgtgagggttttccccttgaggtctgcggcattctcggcggccgcgacggtgttgtctccgccatttaccggatgaccaacacggaccagagcaatgagcacttcatgatggagccgaaggagcagttcgctgtggtcaaaggtttgcgggccagcgggctggagatgctcgccatctaccactcccacccggaaaccccggcccggccgtccgaagaggatatccgtctggccctgacccccaacgtttcctatgtcatcgtctcccttgcagagccggagcggccggtgctcaattccttccgcatcgctgccggccggggcgaacccgaggcggtcggggtcgtttaa

SEQ ID NO: 6800 - DNA, 495 bp, Prochlorococcus marinus MIT 9211
atgaatttgccaactgttattaaattccatggccattccaaagaagttcttattaagagcttgcttattaaatttccacaggaagggtgtgctttattgctaggcaagaaaaaaaaagaaaccaatctttcaaagaattttttttacgaaatttccttaatttggccgtgctgcaatatttgggaacctgagatgaaaagcttttcagaagaatgtcttaaagaagatttgactcaaaagcccccttccaaaacgaaccgttttgcgattgacccaaaagagcaaatttcagctcagaaatgggctagaaaaaaaaacctgtctctattaggttctgctcattcacatagttattcatgtgcaaatccttcaagacttgatctttcttggaatttttctccaggtttaatgattattgttgatggatcgggtgtcattcgtgcatggtggatcggggcctctaaaacaatagaaccaaccgaaatcccgatttaa

SEQ ID NO: 6801 - DNA, 471 bp, Natranaerobius thermophilus JW NM WN LF
atgaaaatatggattttacagacagaatatcagaaaatgttagaacatgctaaaaaagagtttccccttgaatgttgtggcctcatggcaggttttaaaaaaccaaagggctatgtgattacaaatatttatgaaatgactaatatggaacaaagcagtaccaaatactctctagatcctcaagagcaattttccgttatcaaagatattagaaatcatggattagaattagtagggaattatcattctcatccctttacgggttgtcgcctctcagatgaagattttagattagcatacgataacgacttggtttatgcaataatttccttgaaaggtgagttaccagtattaaaattttttttaataaaagagaatttaaaaaatgcaagccaagaactaaatgttcaattacttgtaagtaaagatcaagttatcaattcaaatacaacagatgaaggagggttgtaa

SEQ ID NO: 6802 - DNA, 441 bp, Chlorobium phaeobacteroides BS1
atggagatgtgcaaaagtgtttatgagaagattatagagcatgcccggcgggagacccccctggaagcatgtgggtatctgggtggcaagggtaaaactgtaatcgaggcatattgccttaccaatatcgatcagtcgcgagagcatttctctttcgatccgaaggagcagtttaatgccgtcctgacaatgcgcagcaaaaaacagctggccgtcgccgtctatcacagtcatcctgtgactccggcacgaccttcgcaagaggatatcaggcttgcgttcgaccctgaaatcatcaatgtgatcgtttctctcgctgcccaggagcccgaagtcaatgcgttcagaatcgtgaagggagacgttactgaagagccgcttgttgtcattgaaggattgtgtgaggaaccggaaaacagggagagaagaaatggaacgtaa

SEQ ID NO: 6803 - DNA, 402 bp, Geobacter bemidjiensis Bem
atggtcgagataccgaaagagatactggccgcggtgataagccacgcccagaacgggtttccgctggaggtctgcggcatactgggcggcaacggacaggtagtggcgagccaccatccgatgaccaacaccgacgccagcaacgaccatttcatgatggatccgaaggagcagttcgccgtggtcaaggcgctgcgagcgagcggtgaggagatgctggtgatctaccactcgcaccccgagtcccccgcccgcccctcgcaggaagacatccggctggcgctgacccccaacgtccaccacctgatcgtgtcgcttgaggcacgggacaagccggtcgccaaggcgttccgcatcgaaggcggcgcggtcgaaccggtggagattgtggtagcgggataa

SEQ ID NO: 6804 - DNA, 417 bp, Desulfitobacterium hafniense DCB 2
atgatcaccctgactaaaaagcaaatggaagagatgctggcgcatgcccgccaagctctgcccaatgaggcctgcggactgctgggaggccgtagggatggagatgatcggtgggtagagcgggtttaccccctgaacaatctggatcagagtccggagcatttcagcatggacccccgggaacaattaacggcggtcaaagatatgcggaaaaacggctgggtaatgctgggcaatttccacagtcatccggcaaccccagcgcggccctcggcggaagataaaaggctggccttcgatccatccctgagttacctgatcatttccctggccgagccccaaaagccagtctgcaaaagttttttgatcaaaaaggatggggtagacgaagaagagattattctgaaggaggagtaa

SEQ ID NO: 6805 - DNA, 411 bp, Anaerocellum thermophilum DSM 6725
ttgataatattgccaaaaacattatatgaggagatgttaaatcattgtttgaactccttgcctattgaggcgtgtggacttctgggtggagttattgaggatgaaaagagaattgttaagaaagtttacttgcttaccaatgtagaccaaagttcagaacatttttcaatggacccacttgaacagtttgcagctgtaaaagacatgagaaaaaatggctgggtattacttggcaattttcatagccatccaacatcaccttcaaggccatctgaagaggacaaaagacttgcttttgacagggatttgagctatcttatattatcactcatggatgaaaaaaatcctgttttaaaatcatttaggatatatgaaagctatgtggaagaagaagaaatccaaatcatttaa

SEQ ID NO: 6806 - DNA, 402 bp, Geobacter M21
atggtcgagataccgaaagagatacttgctgcggtgataagccacacgcagagcgggtttccgctggaggtctgcggcatcctggggggcaaagggcaggtggtcgcaagccaccacccgatgaccaacaccgacgccagcaacgaccacttcatgatggacccgaaggagcagttcgccgtggtcaaggcgctgcgggccatcggtgaggagatgctggtgatctatcactcgcaccccgagtcccccgcccgcccctcccgggaagacatccggctggcgctcacccccaacgtccaccacctgatcgtttcgcttgaggcacgggacaagcccgtcgccaaggcgttccgcatcgaggggggcgcggtcgaaccggcggagatcgtggtagcgggataa

SEQ ID NO: 6807 - DNA, 411 bp, Candidatus Methanosphaerula palustris E1 9c
atgatccttcaaccagatatcatggaatctctgtttacccaagcagagtatgaagccccgatcgaggcctgtgggtatctcgcaggtacggatgggcagatcacccgtcatttcccactgaccaacatcgatggaaaagaggatcacttctcgttcgacccgcaggaacagtttgccaccctgaaagcggcacggcaggagggactcagcatcatcgggatgtatcacagccatccggcttcgcctgcacgaccatcaccagaagacgtccggttggcatatgacccgacgatcgtgtatattattatttcactcatgaatgacacaagaaccgtacgtggattttatatccggaaaggagaggttgttgaagaaccattgacaatcggggaaaataccaatgaccaatga

SEQ ID NO: 6808 - DNA, 282 bp, Bacillus cereus ATCC 10987
atgattatcgcttctctctcattcgagtgtatgatctacgatgtgcattctttaaaagagaaacgagcaattttgcaacgggtgttaactcgtgtgaaacagcgttataacgtagctgtttcagaagtagggcatcaagatgtatggcaacgtacagaaattgcgattgtttccgtatcctcaaatcgtgttatttgtgaaaaagaaatgaatcgtgtacttgagtatatcgattcatttcctgaaattgaacgtacgataacacaattggaatggtattga

SEQ ID NO: 6809 - DNA, 279 bp, Listeria monocytogenes 4b F2365
atgattcaatcagtcgttagtgaatttttcatgcaggaaccgcaaaacctcaaagaaaaacgagctatcctgaaacgaatagtaacgagagcaaaacaaaaattcaatatctccattgctgaaacggattatcaggatttatggcagcgagcggaaattagctttgctatcgtatcttcctcgcacatccaagcagaaaaagaagccagagaagtacttgcttttcttgattcttttcctgagtgggaacgcgccgagacagttatggagaagttataa

SEQ ID NO: 6810 - DNA, 282 bp, Bacillus anthracis Ames 0581
atgataatcgcttcactctcattcgagtgtatgatttacgatgtgcattctttaaaagagaaacgagcaattttgcaacgggtgctaactcgtgtgaaacagcgttataacgtagctgtttcagaagtagggcatcaagatgtatggcaacgtacggaaattgcaattgtttctgtatcctctaatcgtgttatttgtgaaaaagaaatgaatcgtgtacttgagtacatcgattcatttcctgaaatagaacgtacgataacacaattggaatggtattga

SEQ ID NO: 6811 - DNA, 282 bp, Bacillus anthracis str Sterne; identical to SEQ ID NO: 6810

SEQ ID NO: 6812 - DNA, 282 bp, Bacillus thuringiensis konkukian
atgattatcgcttcgctctcattcgagtgtatgatttacgatgtgcattctttaaaagagaaacgagcaattttgcaacgggtgctaactcgagtgaagcagcgttataacgtagcggtttcagaagtagggcatcaagatgtatggcaacgtacggaaattgcaattgtttctgtatcctctaatcgtgttatttgtgaaaaagaaatgaatcgtgtacttgagtacatcgattcatttcctgaaattgaacgtacgataacacaattggaatggtattga

SEQ ID NO: 6813 - DNA, 282 bp, Bacillus cereus ZK
atgataatcgcttcactctcattcgagtgtatgatttacgatgtgcattctttaaaagagaaacgagcaattttgcaacgggtgctaactcgagtgaagcagcgttataacgtagctgtttcagaagtagggcatcaagatgtatggcaacgtacggaaattgcaattgtttctgtatcctctaatcgtgttatttgtgaaaaagaaatgaatcgtgtacttgagtacatcgattcatttcctgaaattgaacgtacgataacacaattggaatggtattga

SEQ ID NO: 6814 - DNA, 294 bp, Thermobifida fusca YX
gtgtacgtcggagccctgacgctggacctgctgttgggcgacgtccgttcattgaagcagaagcgttccgttattcgacccatcgtggccgaactccagcgcaaatacagcgtctcggttgcggagaccggcaaccacgacctgtaccggcggtgcgagatcggaatcgcggtggccgcgtccacggcagcgcactgcaccgcgttgatgaactcctgtgaacgcctagtcgccgaccgccccgaagtcgagctgctgtctgcccggcagcggctcttcaacgatgaggaatag

SEQ ID NO: 6815 - DNA, 288 bp, Pelobacter carbinolicus
atggttgtcggggttatgcaggttgaactctttatccatggcgcccaaaaccttaaggccaaacgcgctgtggtcaaaagccttatcgggcgctgccgtgcgcgttttcccgtcagttgcgccgaggtcggacatcgcgatctatggcagaggacgacgatcggcttcaccatagttgaaaaggacgaagcttctgcggatcgaatcctgcagaaggtgattgtagaactcgagcgatcatcgcttgccgaaattatccggcaggacatggaactcatacattattga

SEQ ID NO: 6816 - DNA, 456 bp, Anaeromyxobacter dehalogenans 2CP-C
atgttcgtcggagtcctcaggctgacgctgcacctcccggagcccggctcgctcaagtcgaagcggcacctgatccgctccgcgctggaccgggtgcgcgcgaagttcaacgtgtcgatctcggaggtcgccgagaacgacctgtggcagcggagcgtggtgggcgtggccgcggtcgggaacgagcacgccttcgtgaacgaggtgctcgacaaggtggccgacttcgtcggctcgatgcacggcgggcagatcctggtcaccgcgcgcgacatcgagatcgtcccgtacggcgacggcatcggcgagggcaccacgcgcacgctggcggaggccgagggcgcgccgtcgtggggcgacgagggcgcccgcgagcaggagccgcgcttcccgaggccgaggccgcggccgcgcgacgaggacgagcaccaggacgagggagacgacgagccgtga

SEQ ID NO: 6817 - DNA, 399 bp, Frankia CcI3
atgtggatcggaaccctcagccttgatctgctgctcggtgacgtgcactcgttgaaggagaaacggtcggtggtgcggccgatcgtggcggagctgcgtcgccgtttcgccctcagcgtggccgagaccggccatcatgatctgcaccggcgagccgagatcgggatggcggtcgtcgccgcggaccgggcgcactgcgtcgaggtcctctgttcctgcgagcatctggtggcccagcgaccggacgtcgaggtcctcgccgcgcgggcgcgctacttttcggcggacgacgcggacgacgaaccgcatgcacccggtgaaccgcacgcacccggtgcatctgccgcggtgagcgtgccgccggcgggaccggcgaacgaggaggtggacggtggctga

SEQ ID NO: 6818 - DNA, 291 bp, Candidatus Koribacter versatilis Ellin345
atggcaatcgcatatctgaccttggaattgcgcatggaaactgcgcattccctgaaagacaagcggcaggtcgtgcgcagcttgaaagataagttacgcgccagctttaacgtgtcggtggccgagattgagaacctggacttgtggcaactggcgaccatcggcgtagtcagcgtgtcagactcgcgcgactatctcgaagggcttatgcgaaacgtggaaagcgctgctacccgtatcgcaaataatgctggtgccgacgttaccgattcgtttctggatttcgtctaa

SEQ ID NO: 6819 - DNA, 282 bp, Rubrobacter xylanophilus DSM 9941
ttgttctgcaccatacggctagagctggagctgccctacgcctccagcctgaaggataagcgccagacgctgcgttcgctcaaggaccggctgcggcggcggaacgtctcggtcgccgagtgcgacaaccacgacttctggcagcgggccaccctggagctcgcggtggccgccgtctcccggggcgccgccgaggagaagcgggaggaggtccgccgcatgctgctgaactacgaggagctggcgatcctggagtggtacgaggagttcgtgaagctgtga

SEQ ID NO: 6820 - DNA, 273 bp, Syntrophobacter fumaroxidans MPOB
gtggtcttcaggctccatgggaatcagtcgctcaaggacaagcgcagcgtggtcaagagcctggttgagaagagccggcacaggttcaacgtgtccgttgcggaagtcgccgaccaggacctccaccagaaggcgacgatcggcatcgcggtcatcggcagcgacggacgggtgatcaattcggttttggaccgcatcatggctttcatggagtcgctcggccttgcggagctcgtagcgcaggagatcgagctgattcctctcggggaatag

SEQ ID NO: 6821 - DNA, 300 bp, Acidothermus cellulolyticus 11B
gtgttcaccgggattctcaccctcgatctgcggctgggcgatgtccattcgctcaaggagaagcggggagtggtccggccgatcctcgccgaggtgcgccgccgtttcgaggtcgccgtcgccgaggtcggtcacctcgatctgcaccgtcggtcactcatcggcgtcgcggtcatcgcggcggatgccgcgcactgccggcatgtcctcgaggcctgcgaacggtgggtggccgatcggccggacgtcgaactgctctcggcgcatcagcgccttgtcggggaagaggacgacgaatga

SEQ ID NO: 6822 - DNA, 291 bp, Desulfovibrio vulgaris DP4
atggttcttggtgtactgaccgtagaataccgcctgcacggcaacgactcgctcaagggcaagcggcgcatcgccaacagcctcaagcagaaggtgcgcaacaccttcaacgtggccatcgccgaagtcgaaacagaagactccctcaccatgctgcgtctcgcggtagtctccgtcagcaacagccaccagcaccttcagagccgtctcgacaaatgcctcgctatgatggaggccgtctgtcccgaagagatggtctacagcgacattgaaatcttcgcggccgactga

SEQ ID NO: 6823 - DNA, 282 bp, Bacillus cereus cytotoxis NVH 391-98
atgattatcgcttcgctctcattcgaatgcatcatatacgatgtgcattctttaaaagagaaacgagcaattttacaacgtgtgctaacccgtgtgaaacagcgacataatgtcgctgtttctgaagtggggcaccaagatgtatggcaacgtgcggaaattgcaattgtttctgtatcctcaaatcgcgttgtctgcgagaaagaaatgaatcgtgtactagagtatattgactcatttccggagatagaacggacgataacgcacttggaatggtattga

SEQ ID NO: 6824 - DNA, 330 bp, Frankia EAN1pec
atgtggatcgggagcctgacgctggacatcctcctcggggatatccattccctgaaggagaagcggtcggtcgtccggccggtggtcgccgagctgcgccggcggttcgcggtcagcgccgcggagaccggcggcctggacctgcaccgccgcgtggagatcggggtcgcggtggtcgccgcggaccgcgcgcactgcgcggcggtcctcggcgcgtgcgaggagctcgtcgcacggcggccggagttggagatcctctcggcgcgagtacggtacctctccgaggacgacgccgacgacatgacccatcctgaggtgattttgccgtaa

SEQ ID NO: 6825 - DNA, 315 bp, Candidatus Desulfococcus oleovorans Hxd3
atggaaagaacaatggaacaggggtccatggtcgcggggctgggtcttattgtgctgcatatcgacgggtgccggtcgctgaaggagaagcgggccgtggtcaaggcgatgatcgcccggctgcgcaacgcgtttaacgcgtcggtggccgaggtggggctcaacgatcttcaccgaagcgcccatatcggtattgccctggtgggtaacgatgtgtcggtggtcaatgcccggatggaccagatgttcaacgcggccgatcagatggggcagggccgggtgattgatacccagatggaaatttttaccatatga

SEQ ID NO: 6826 - DNA, 300 bp, Salinispora arenicola CNS-205
gtgacgatgttcaccggaaccgcggtattcgaccttctgctgccgggcgactcccggtcgctcaaggccaagaggtcatacgtccggccgatcgtggcggcgctgcgccggctcgaggtgtcgaccgccgaggtgggggcactcgaccggtacgggcggtcggagatcggcgtcgcggtggtggccgcgacggcggcccacgtcggcgaggtgctcgactcctgcgagcgtgtggtcgccgcacgccccgaggttgagctgctgtcggtgcgtcgacggctgttcggcgcggacgactga

SEQ ID NO: 6827 - DNA, 282 bp, Bacillus weihenstephanensis KBAB4
atgattatcgcttcactctcattcgagtgtatgatttacgatgtgcattctttaaaagagaaacgagcaattttgcaacgtgtgttaactcgtgtgaaacagcgctataatgtagctgtttctgaagttgggcatcaagatgtatggcaacgtacagaaattgcaattgtttccgtatcctcaaatcgtgttgtctgtgaaaaagaaatgaatcgtgtacttgagtatatcgattcatttcctgaaattgaacgtacgataacacatttggaatggtattga

SEQ ID NO: 6828 - DNA, 282 bp, Bacillus cereus AH187
atgattatcgcttctctctcatttgagtgtatgatttacgatgtgcattctttaaaagagaaacgagcaattttgcaacgggtgttaactcgtgtgaaacagcgttataacgtagctgtttcagaagtagggcatcaagatgtatggcaacgtacagaaattgcgattgtttccgtatcctcaaatcgtgttatttgtgaaaaagaaatgaatcgtgtacttgagtatatcgattcatttcctgaaattgaacgtacgataacacaattggaatggtattga

SEQ ID NO: 6829 - DNA, 282 bp, Dictyoglomus turgidum DSM 6724
atgttgataggtgtttgtagagtcatcatatccatacccgatagcttctcgcttaaggaaaaaagaaaggtcaaaagaagtattgtggatagagttagagcaaaatttaatgtttctattgcagaggtagattctcaagagatatggaatgaattagtccttggaataagtatggtttctacagaatcaaaacatatatatgaagtaatgtcggagataataaaattaatagaggaacaaaaagaggctgaactaatagattacgaaattgacatcttatga

SEQ ID NO: 6830 - DNA, 282 bp, Bacillus cereus B4264
atgattatcgcttcactctcattcgagtgtatgatttacgatgtgcattctttaaaagagaaacgtgcaattttacaacgtgtgttaactcgtgtgaaacagcgctataatgtagctgtttctgaagttgggcatcaagatgtatggcaacgtacagaaattgcaattgtttccgtatcctcaaatcgtgttatctgtgaaaaagaaatgaatcgtgtacttgagtacatcgattcatttcctgaaattgaacgtacaataacacatttggaatggtattga

SEQ ID NO: 6831 - DNA, 282 bp, Bacillus cereus G9842
atgattgtcgcttcactctcattcgagtgtatgatttacgatgtacattctttaaaagagaaacgggcaattttgcaacgagtgctaactcgtgtgaaacagcgctataatgtagctgtttctgaagttgggcatcaagatgtatggcaacgtacagaaattgcgattgtttccgtatcctcaaatcgtgttatctgtgaaaaagaaatgaatcgtgtactggagtacatcgattcatttcctgaaattgaacgtacgataacacaattggaatggtattga

SEQ ID NO: 6832 - DNA, 309 bp, Desulfovibrio vulgaris  Miyazaki F
atgctgcgcggcacccccatgatcatcggcgtgctcacggtggaattcgagttgcacggcaacgattccctgaaggggaagcggcgcatagccagcagcctgaagacgaaggtacgcaacaccttcaacgtgtccatcgcagaggtgcgcaaccaggattccctgacccggctgtcgctggccgtggtttcggtaagcaacagcgagcggcacctgcaaagccgcctcgacaagtgcctggccatgatggaagccgtgtgccccgaagagatgacgtacagcgatattgaatttttcgccgccgaatag

SEQ ID NO: 6833 - DNA, 456 bp, Anaeromyxobacter dehalogenans 2CP 1
atgttcgtcggagtcctcaggctgacgttgcacctcccggagcccggctcgctcaagtcgaagcggcacctgatccgctccgccctcgaccgggtgcgcgccaagttcaacgtgtcgatctcggaggtcgccgagaacgacctgtggcagcggagcgtggtgggcgtggccgcggtcgggaacgagcacggcttcgtgaacgaggtgctcgacaaggtggccgacttcgtcggctcgatgcacggcgggcagatcctggtcaccgcgcgcgacatcgagatcgtcccgtacggcgacggcatcggcgagggcgccatgcgcacgctggcggaggccgagggcgcgccgtcgtggggcgacgaggacgcccgcgagcaggagccgcgcttcccgaggccgcggccgcggccgcgcgaggacgacgagcaccaggacgagggagacgacgagccgtga

SEQ ID NO: 6834 - DNA, 297 bp, Actinosynnema mirum DSM 43827
ttgtacgtaggagcactggagctcgacctgctgctgggcgacgttcactcgctcaagcagaagcgatcggtggttcggcccgtcgtggccgaactgaagcgcaagttcgaggtgtccgcctccgaggcgggccacctcgacctgcaccggcgcgctctgatcggagtggcggtcgtcgccgccgacgcggagcatgtcagggatgtcctcgccgcctgcgagcggctcgtcgcgggacgccccgaactggaactgctctccgcccgccacaggctggtcgggccggaggacgtgtag

SEQ ID NO: 6835 - DNA, 288 bp, Desulfomicrobium baculatum DSM 4028
atgatcatcggcaccctgcgccttgaattcaggctgcatggcgttttttccttgaaggaaaaacgaaaaagcgccaacagtttgaagcagaagctgcgcaacaccttcaatgtgtccgtggccgaaaccgaagcccaggattcccatcaggtcctggttctcggagtggttacggtttccaacgacacggcacacgtgcacagccgtctgtccaaagtcctggccatggtggaagcttccaccgccgacgagcttgttcatgccgacatgaacgtatttggagcctga

SEQ ID NO: 6836 - DNA, 279 bp, Geobacillus WCH70
atgatcggctttgtcgcctgtgaatgtgtaatttatgatgcgcaatcattaaaagaaaaacgtgctgtgttacaacgaataatgacacggttaaaacaaaagtataatatatctatagccgaaatcgatcaccaaaacgtatggcagcggactacgctcgggattgtcgcgattacgtccaatcgggtgacaaccgagcgggagctgcagcgagcgcttgctttgatcgattcctttccggaattggaaagaacggttacgacatttgagtggttttaa

SEQ ID NO: 6837 - DNA, 282 bp, Catenulispora acidiphila DSM 44928
atgaccctcgacatcctcctgggcgacgtgcgttcgctgaaggagaagcgcgggatcgtgaagccgatcctggccgagttggacaagcgcgccggtgtcggcgccgccgagaccggccatctggacctccaccgccgcgccgagatcggcgtcgcggtggtcgcggcgaccgccgcacgagtgaaggaagtcctcgacgatctggaaggcaccgtagcgtggcgcccggagatcgagctgctcagcgtccgacgacgcctgcgcagcgatgaggacgattag

SEQ ID NO: 6838 - DNA, 294 bp, Saccharomonospora viridis DSM 43017
atgttcgtcggcacactggaattggatgtgctgctcggtgacgtacggtcacggaaacagaagcgctccgtggtacgcccgatcatcgccgagttgcgcaaacgctatgaggtggcggtagccgagactgggcacttggatctgtatcgacggtcgctgctcggtgtggcgacggtggccgtggacggtgctcatgtgcgggacatactggactcctgtgagcgtctcgtggcggagcgcccggagatcgagttgttgtccgcgcaccgacggcttttcggtccggacgactag

SEQ ID NO: 6839 - DNA, 288 bp, Desulfohalobium retbaense DSM 5692
atgcatataggccttctcagcattgaattttatctgcacggcatcggctcgctcaaggataagcgtcgcattgccaacagcttgaaacagaagttgcgcaacaaattcaatgtcgccgtagccgaaatcgacacccagcacagccacacctggctgaaactggagatattgaccctggccaatgaacgcgctcgcgtcgaaagcgttctgaacaaggccctggctatggtcgaggccatctctgacgaagagatcaccgacgtgcacaccgatatatttggagtctaa

SEQ ID NO: 6840 - DNA, 315 bp, Nakamurella multipartita DSM 44233
atgatcaaccgggatggggcggtctacgtcggcgtcctggagtgcgacgtgctgctcggcgccgtcggttcgctcaagcagaagcgggccatcatccggccggtgctggcccggttgcggcggttggacgtcgccgccaccgaggccggcgatccggaccggcatcgccgggccctgatcgcgatcgctaccgtggccggcgaccccgctgcggtgcagcgggtgctggacacctgcgaacgacagatcgtcggtgaggttgagttcgaggtgctgtccacccggcgacgggtggtcggtgcgcacgacgaatag

SEQ ID NO: 6841 - DNA, 408 bp, Nitrobacter winogradskyi Nb-255
atggacatggcgctttccgcaaccgacatcatcgaacggcttgatcttcagccgcacccggaaggcggtcactatcgagagacgttccgcgacacccgtaccgacgggcatggccgcgccgcgtccaccgcgatctactttctgctggcgcgcggtgagcgctcgcaacggcatcgcatcgatgcggtggaggtctggcactattatgccggcagtccgctgctgctgcggatcgaagacggcgccgtcacgcgcacgctccgtctcggcgcggatctcgccgcgggcgaaacaccgcaggcgctggtacccgcttttgcctggcagagtgcggaaagcaccggtgactggacgttggtgggatgcacggttgcgccggggttcgaattttccggctttgaattgtag

SEQ ID NO: 6842 - DNA, 438 bp, Rhodopseudomonas palustris HaA2
atgcgggcgacgctgtccgccgcggaggtgatcgcgcaactcggcctcgcgccgcatcccgaaggcgggcactatcgcgagacgtttcgcgattcccgctgcgactccaccggccgcagcgcctcgaccgcgatctacttcctgttggcgcgcggcgaacgttcacactggcatcgcatcgacgcggtcgagatctggcactactacgctggcgcgacgctgacgctggaaatcgccgacgacaacggccaccgcgcggtcgcgctcggaccggacgtcgcagcgggcgaaaccccacaggcgatcgtgccgccgcaggcctggcaggccgcggtctcgaccggcgactggacgctggtcggctgcacggtggcgcccggtttccagttcgagcatttcgaactggccccgtcgggctggtcgccgcggccggggtga

SEQ ID NO: 6843 - DNA, 444 bp, Rhodopseudomonas palustris BisB18
atgcccccggctcacgacctcaccgccgccgagatcatcgcccggctggagctggcgccgcatcccgagggcgggcatttccgcgagacgtttcgcgatgcccgcgtcgacccggcggggcgcgcggcctcgaccgcgatctatttcctgctggccaagggcgagcgctcgcactggcaccgcatcgacgcggtcgaggtctggcactactacgccggcgcgccgctggagctgcagatcgccgacgccgaaggtcgccgcaccctgcggctggggccggatctcgccgctgggcaattgccgcaaggcctcgtgccgccgcacgcctggcaggccgcgcaaagcagcggcgactggaccctggtcggctgcaccgtggcgccgggcttcgatttcgcgacgttcgaactggcggagaagggctgggagccggctgcccgatga

SEQ ID NO: 6844 - DNA, 429 bp, Rhodopseudomonas palustris BisB5
atgccgtcggcggccgagatgattgcgcggctgaagctgcagccgcatcccgaaggcggccattttcgcgagacctttcgcgacccgcgctgcgacgcctccggccgcagcttctcgaccgcgatctacttcctgctggcgagcggcgagcgctcgcactggcaccgcatcgatgcgatcgaggtctggcactattacgccggcgcggcgctggcgttggagatcgccgacgccgacggccatcgcgcgattcggctcggccccgatgtcgcggccggcgaacagccgcaggcgatcgtgccgccgcacgcctggcaggctgcggtcacgaccggcgactggaccctggtcggctgcacggtggcgcccggcttcgcgttcgagcatttcgaactggcgccgccggactggtcgccgcttcgccgctga

SEQ ID NO: 6845 - DNA, 411 bp, Nitrobacter hamburgensis X14
atggatatggcgctctccgccgccgacatcatcgcgcggctgggtctcaaaccgcacccggaaggcggccactatcgcgagacctttcgcgacgtccgcaccgacgaccagggccgcgccgcctcgaccgcgatctatttcctgctggcgcgcggcgaacgctcgcgccggcatcgcatcgatgcggtggaggtctggcactactacgccggcagcccgctgctactgcagatcgacgacggcgccatcatgcgcacgatatgtctcggcgcaaatctcgcggcgggcgaagtacctcaagcgctggtgcccgcttatgcctggcagacggcacagagcagcggcgactggacactggtgggatgcacggtggcgccggggtttgaattctccggcttcgaactgggttag

SEQ ID NO: 6846 - DNA, 453 bp, Maricaulis maris MCS10
ttgagcgcccccgaaccggccctgcccgacgatgcccggcgcattgtcgacacgctcggaatgcagccgcatccggaggggggctggtatgtcgagaccctgcgcgacccggacccggcgggcgggcgcgaccgctcaaccgcgatatattatctgctcgctaccggcgaacactcccactggcaccgggtcgatgcggttgaaatctggcactggcatgccggctcgccgctcgatctgggggtcagtgtggacggacagtcggcaacaacgcttctactcggccccgacctggcaaacgggcagctaccgcaaggcattgtcccggagggcgcctggcaaagcgccaggtccacaggacagtggacactggtcggctgcaccgtggcaccgggtttccattttgaaggatttgagctggcaccgccggactggtcaccggggcagggatag

SEQ ID NO: 6847 - DNA, 339 bp, Bradyrhizobium BTAi1
ttgaatgccgccgggcgcgccgcgtcgaccctcatctacttcctgctcgcccgcggcgagcgctcacattggcacagggtcgatgcggtcgagacctggcacttctatgccggcgcgccgctcactttgcggatcgctgccgccggacagccaccgcgcacgacgacgctcggcattgacctcgctggcggccaggagccgcaggcggtggtcccggctcatgcctggcaagccgccgagagcaccggcgactggaccctggtcggctgcacggtggcaccgggattcgaatttgccggattcgagctcgcgccgcagggctgggagccgtcgatgtag

SEQ ID NO: 6848 - DNA, 465 bp, Sinorhizobium medicae WSM419
atgacgacccgggagatgacggcggcagccattatcgaaaccctgaggctcgcgcggcatcctgagggtggctggtatggcgagacattccgcgacgccgacggcggtccgcgcggtcactcaacggccatatactacctgctcgagcggggcgaccgatcgcactggcaccgcgttcgcgatgccgcagaggtctggcactactacgccggcgcgccgctcgaacttagcattggcgaaccaggcaggcccccttctcaggtccggctgggctcagacattcccgccggagaacggccgcagcatgtcgtccccgccaactggtggcaatccgccgcttcgctcggagactggacgctcgtcggctgcaccgttgcccccgggtttgattttaccgtcttcgagatggcgcccccggaatggcagccgcctgacgcacacaaaggggctcaagtgaacgggtga

SEQ ID NO: 6849 - DNA, 435 bp, Parvibaculum lavamentivorans DS-1
atgacattggataccggcctcgacgccgacggcatcatcgaacttctccagttgaagcctcatcctgaaggcggctatttcgccgaaacctttcgcgatccggcgggcggcacccgtgcctattcaactgccatctattatctgctgaaggaaggagagcgctcgcactggcaccgcgtggacgccgccgaaatctggcactggtatggaggcggacctctggctctttccttctacgaagaaggccgcgaggcagagacgcgcattctcggcagcaacctcgatgcgggggagcgcccgcaactcgtggtgcccgcaggcatctggcaagcggccgagccgcttggcctctggacacttgtcggctgcaccgtcgcgccgggctttgaatttggcggattcgagatggcggagccgggctggcagccgggttaa

SEQ ID NO: 6850 - DNA, 465 bp, Xanthobacter autotrophicus Py2
gtggctgatgggctcaacgggctgaccgccgaggaggtggtcgccctcctccagctccagccgcacccggagggcgggcatttccgcgagaccttccgggatcggccggcgggccgcgatgctgcaggcggggcgcggggcgcctccaccgccatctatttcctgctgaaagagggccagcgctcccactggcaccgggtggacgcggccgaaatctggcactggcatgccggcgcgccgctgacgcttgccatcgccgatggcgaaggccggcgcgagctggcgctggggccggatctcaaggcgggggagaggccgcaggcggtggtgccgccgttcgcgtggcaggcggcgcaaagccggggggcgtggacgctggtgggctgcaccgtggcgccggcgttccagttcgagggcttcgaactggccccgcccggctgggagccggacgaagggccggcttag

SEQ ID NO: 6851 - DNA, 465 bp, Caulobacter K31
atgacgttcatgggcagcggcaaggcgatttccggcgacctgggcggcaaggagatcatccggctgctggaccttcagccccatcccgagggcggctggtatcgtcgaaccttcgaggatgaagctcaggtcgacgggcgaccggcgtcgacggcgatctactatctgctgcaggccgaagagatgtcggcctggcatcggatcgacgccgtggagatctggcatttccacgccggcgcgccgctctccctgaccctgtcgccgccggatggccgtggcgcgaccgcgcacaccctgggttcggacctgcgggccggctgccggccgcaggtggtggtgccgacgggctggtggcagaccgccgtcagcctgggcgcctggagtctggtcggctgcaccgtggcgccaggcttccggttcgagggtttcgaactggcgccggaaggctggcggcccacggtctga

SEQ ID NO: 6852 - DNA, 435 bp, Beijerinckia indica ATCC 9039
atgatcctggccgatcgcaccgcgcaagacatcattacggccctcgccttgaagccacatccggaagggggccatttccgggaaaccttccgtgatccccgctccgatgcggaggggcgttccttttcgaccttgatctattttctgctggcggccggtgaaacctccgcctggcacaggatcgatgccgcggaggtctggcatttttatgccggcgcgccgctcgacctccgcattacagaggcgggcaaatccacgagccaccgccttggcgcggatgtcttgaacggagaggagccgcaaatcgtggtcccagcccttgcctggcaaagcgcccgcagtcttggtgcctggacgcttattggctgcagcgtcgcacccgcctttcagttctcaaccttcgaaatggcgccggcgggttggcagcccgattga

SEQ ID NO: 6853 - DNA, 402 bp, Rhodopseudomonas palustris TIE 1
gtgcggctcggtctgcagccgcacccggagggcggacactatcgcgaaacgtttcgcgatccccgctgcgacgccagcggacgcagctactcgaccgcgatccactttctgctgcgggcgggcgagcgctcgcactggcaccggatcgatgcggtcgaagtctggcactattacgcaggcgcggccctgatgctggaagtcgccggcgaagacggtcaccgcgccgcgacgctcggcccagatctcgtcgccgggcatctgccacaagtgatcgtgccgccgcaggcctggcaggcggcaacatcgaccggcgagtggacgctggtcggctgcactgtcgcgccgggcttcgatttcgccggcttcgaactggcgccgcccggctgggagccggcgcgatga

SEQ ID NO: 6854 - DNA, 444 bp, Methylobacterium sp. 4-46
gtgacagcctccagcctcaccgccgccgaggtgatccgcctcctcgacctcaagccgcatccggagggcggccattaccgcgagaccttccgcgacccgcaccagatcgagggtcgggccgcctcgacggcgatctactacctgctcgacgtcggcgagacctcggaatggcaccgggtcgatgcggccgagctgtggttctggcacgcgggcgcgccgctcgtgctgacggtgagcccgaacggccacgacgccgaggcggtgcatctcggccccgacctcgcccaccgtcagcggccgcaggccgtggtgccggccggccattggcagaccgcgaccagcctcggcgcctggacgctggtgagttgcaccgtggcgccgggcttccgcttcgaggggttcgaaatggcgccgaaggactggcgcccgctgccgcggcgatga

SEQ ID NO: 6855 - DNA, 423 bp, Rhizobium leguminosarum bv  trifolii WSM2304
atgtcgcctgaggacatcatccgcgaactcggcatgcagccgcatccggaaggcggctggtatgtgcagacattccgcgacacggcaggcggagaccgcggccactcgacggcgatttattacctcctgaccagagggcagcgctcgcactggcatcgcgtccacgacgcggtggaggtctggcattattacgccggcgcgccgctcgctctgcagcgctctgaagacggaacggcaagcgagaccttgacgctcggaaccaatctgtcggacggcgagcggccgcaggcgatcgttcccgccaattggtggcaagcggccgaaagcctcggtgagttcacccttgtcggatgtaccgtttcacccggcttcgaattttcgagcttcgagatggcgcaggcaggctggacgcccggcggctga

SEQ ID NO: 6856 - DNA, 468 bp, Methylocella silvestris BL2
atgagcgggccgccgccgagcgactgcgaggccgcgagcgccgatgaaatcatcgcgcggcttgagctcgcgccccatcccgaaggcggctggtacaaggagacgtttcgcgatcaggcgacggacgcatccgggagggcggcctcaaccctgatctatttcttgctgcgggaaggcgagagatcaaactggcaccgaatcgacgccgcggagatctggcacttttatgccggagctccgctcgccctcagcctgtcgcaaagcggcgaaacggtcgaccgtcatattctcggcagggagctgctcaaaggcgagcggccacagttgatcgcgccagcggggtggtggcagagcgcggcgagccttggacgatggacgctggttggatgttccgtcgcgccgggatttgaattttcccgcttcgaactcgcgccggcgggatggcggcccgctgcgggcgaggggtga

SEQ ID NO: 6857 - DNA, 447 bp, Methylobacterium nodulans ORS 2060
gtgacctcctcccccagcctcaccgccgccgaggtggtgcgcctcctcgacctgaagccgcatccggagggcgggcattttcgcgagacttttcgcgatccgcgggagatcgatggccgcgcggcctcgacggcgatctactacctgctcgatgtcggggagacctcggagtggcaccgggtcgatgcggccgagatctggctctggcacgcgggcgcgcccctcgtcctgaccgtcagcccgaacggccacgacgccgaggcccggcatctcggcccggacctcgcccgcggccagcggccccagatcgtcgtcccggccggccattggcagacggcgaccagcctcggcgcctggacgctcgtgagctgcacggtggcgcccggctttcgcttcgagggcttcgaactcgcaccgccgaactggcggccgatgccgcggggctga

SEQ ID NO: 6858 - DNA, 432 bp, Agrobacterium vitis S4
atggccgatgccgatgagatcattgcagcgctggccatgcagccccaccctgaaggtggctggtacagcgaaaccttccgcgacggcgcaggtggagcgcgtggccattccacggccatctactatctgctgaaagcaggccagcgatcgcattggcatcgggtcaaggacgccgccgaggtctggcattattatgctggcgcgccgctggcgctttaccgttcgaatgacggacaatccgtggaaaccttggttcttggtagagaccttgtgcgcggcgagcgaccccaggccatcattccagcgcttagctggcaggccgcggaaagccttggggagtacacactggttggctgcacggtcgcaccgggctttactttcgacgctttcgaaatggccccgccggactgggaaccaggtcagcctctttga

SEQ ID NO: 6859 - DNA, 423 bp, Rhizobium leguminosarum bv  trifolii WSM1325
atgtcgcctgaggacatcatccgcgaactcggcatgcagccgcatcccgaaggtggctggtacgtgcagacattccgcgatacggcgggcggggaacgcggccactcgacagcgatctattacctgctgaccaggggacagcgttcgcactggcatcgcgtccatgacgcggcggaggcctggcattattacgccggcgcgccgctctcgctgcaccgctcggaagacggaacggcaagccaaaccctgacgctcggaaccaacctgtccgccggcgagcggccgcaggcgatcattcccgccaattggtggcaatcggccgaaaccctcggcgatttcaccctggtcggctgcaccgtctcgcccggcttcgagttttcgagcttcgagatggcgccgcccggttggaagcccggcggctag

SEQ ID NO: 6860 - DNA, 783 bp, Arthrobacter FB24
gtgaacctcacaagcagcaccagcacgaacaacaccacgccggacatcgagaccttccacggttccagcctggaactgagaaacctgaccatggcctacggcgaggtcgaggtcctccgcaacgtaagtctcactgtggcccccggcaccacaacgtgcatcatcgggccttcaggttccgggaagtcaaccctgcttcgcggcataaaccgcctgcatgaacccaagagcggggacgtcctcctggccggccaaagcgcactcgaagtcaagccggacaccctgcgggcccgcatcggcatggtcttccagcacttcaaccttttcccggaccataccgccctcgaaaacgttgccttggccctctggagcgtcaagggcatgcccaaggccgaggcgagggagcgcgcccgccgccgccttgccgaagtgggcctcgcggaacgtgccgaccaccgcccgcgcgacctctccggtggccagcaacagcgtgtcgccatagcccgggccctggccatggagcccgaggtgatgcttttcgacgaggcaacaagcgcattggatccagagctcgtcaaaggcgtgctgaacctcatggccgggctcggcaaacggggcatgaccatgcttgtagtcacccatgaaatgggtttcgcccgcaaagtggccgatcaggtcgtcttcatggatgaaggcgaggtggtggaggcaggcacaccggcggaaatcttcgacaatccccgcagcgaacgtctacggcgcttcctgtcggaggtgctgtaa

SEQ ID NO: 6861 - DNA, 726 bp, Shewanella baltica OS185
gtgattaaaataaccaacctgcataaaaacttcggcgataacaaagtgctcaagggcattagcgagcatattcgtcagggcgaagtggtgagtgtgatcggcccaagtggcagtggcaagagcacctttttgcgttgtattaatctgttagagcagccaagccaaggcgatatcgagattgaaggtcaattgatcacagcgccaaacgcctgcgtcgataaactgcggcaaaaagtgggcatggtgtttcaaaactttaacctgttcccccataaaaccgtcattcaaaacatcaccttagcacccatcagcctaaaactgatgacgccagctcaggccgaaacgaaagccctcgacctactggcacaggttggcttgagtgacaaagccaatgcctatcccgctagtttatcgggcggccaaaagcaaagggtcgccattgcccgcgcattagcgatggaaccagacttgatgttatttgatgagccgacatcggcactcgacccagaaatggtcggcgatgtgctagacgtgatgaaagacttagcgctaaagggcatgaccatggtcattgtcacccacgaaatgggtttcgcacgggatgtatccgatagggtgatctttatggacggcggttatgtggtcgaatcgagcccaccagatgagctattcaccaatcccaaagaagcccgtacccaagcgtttttaagcaaggtactgcgctag

SEQ ID NO: 6862 - DNA, 723 bp, Bacillus cereus cytotoxis NVH 391-98
gtgattaagattgaaaatcttcataaatcatttggagaacataaagtattaaaaggaattacgacaacaattgaaaagggagaagttgttgcaattgttggaccatctggatcggggaaatcaacttttttacgttgtatgaatgtattggaaacaccgacaagcggaagtatttggatcggagataaagaagtaacaaatctgaaaacgaatatgatgaatgtacgtgaaaaagtcggaatggtatttcaacattttcatttattcccacatatgaccgtgctagaaaatattatatatgctcccgtgaatgtaaaagggatagctaaaggaactgcggaacaaaaagcaatggaattattggaaaaagtaggattgctaaataagaagggggcatatccaaatcgcctatctggaggtcaaaagcaacgcgtggccatcgctagagcattagctatggaaccggaagtgatgttatttgatgaaccaacttctgcactggatcctgagatggtaaaagaagtattggaagtaatgaaatcattagtgactacagggatgacaatggtaattgtgacacatgaaatggggtttgcgaaagaagtagcggatcgtgtccttttcttagatggtgggaaacttgttgaagatacaactccgcagcaattttttacagagccaaagagcgatcgtgcgaaagtttttttacaaaaaatattgtaa

SEQ ID NO: 6863 - DNA, 729 bp, Campylobacter hominis ATCC BAA-381
atgattgaaattcaaaatttaactaaaagttacgggtctcttttagttttagataatatatcaaaaaaaattcataacggaaatattgtagccattataggtccaagcggcggtggaaaaagcacatttttacgctgtttgaatttactggaaattcctgatggcggtaaaataatcataaacggcgaagatataacaaataaaaaaacagatataaataaagttcgtcaaaaagttggtatggtttttcaacatttcaatctttttgcaaataaaaatgtgcttgaaaatttaactttggctcctataatgaccggtattttgacgcacaaagaagcttataaaaaagccgaaagtttacttgaaagagtagggttgctggataaaataaattattttccacacaaactttcaggcggtcaaaaacaaagaattgcaatagcaagaagcttaatgatgaatcctgatgttattttatttgatgagcctacatcagctcttgatcctgaaatgataggagaagtgctgactttgatgaaagatgtcgcaagagacggtcttacaatgcttgttgtaacgcatgaaatgggatttgcaagaaatgtcgcaaaccgcatatttttcatggaaaagggcaaaatcgcagttgacgatacgccgaaaaatgtttttgaaaatccgcaaaatacgagattaaaagagtttttaaataaaattttaaatcactga

SEQ ID NO: 6864 - DNA, 726 bp, Shewanella baltica OS195; identical to SEQ ID NO: 6861

SEQ ID NO: 6865 - DNA, 744 bp, Clostridium phytofermentans ISDg
gtgaccactgatgcacaagtaataattaaagttgagaaccttcataaggcatacaataaagtatatgcattaaatggtatcaatgaagagataagaaaaggtgaggtagttgtcattgttgggccatctggttctggtaaatctacctttttaagatccttaaatttattagaagttcctacggaaggtaagatattctttgaaggggtagacattacagataaagcaacagatatcaacaagcatcgccaaagaatgggaatggtattccaacactttaatctcttccctcatatgacaattttaaagaaccttatgattgcgcctatgaaacttcaagggaaaagtgaagaagaggctaagaaaaaagcacttgaacttttggatagagttggtttagctcatcgtgcagatgcatatccatcccaactatccggtggacaaaaacaaagaattgcaatcgttagagcactcgcaatggatcctgaggtaatgctattcgatgaaccaacttcagcattagatcctgaaatggttggtgaagttcttgatattatgaaggaacttggcagagaaggcatgaccatggttgttgttactcacgagatgggatttgcgaaagaagtggctgaccgtgtaatgtttattgaccaaggtgttgttcaggaacaaaatagtccagctgaatttttcggtaatcctcagaatcaacgattaaaggatttcttgtcgaaagtattataa

SEQ ID NO: 6866 - DNA, 726 bp, Shewanella baltica OS223
gtgattaagataaccaacctgcataaaaacttcttcgataatctcgtgctcaggggcattagtgagcatattcgtcagggcgaagtggtgagtgtgatcggcccaagcggcagcggtaagagtacctttttgcgttgtatcaatctgttagagcagccaagccaaggcgatatcgagattgaaggtcaactcatcacagcaccaaatgcgagcgtagataaactgcggcaaaaagtgggtatggtgtttcaaaactttaacctgttcccccataaaaccgtcattcaaaacatcaccttagcacccatcagcctaaaactgatgacgccagctcaggccgaaacgaaagccctcgacctactggcacaggttggcttgagtgacaaagccaatgcctaccccgccagtttatcgggcggccaaaagcaaagagtcgccattgcccgtgcattagcgatggaacccgacttgatgctgttcgatgagccaacatcggcactcgatcctgaaatggtcggcgatgtgctagacgtgatgaaagacttagcgctaaagggcatgaccatggtgattgtcacccacgaaatgggtttcgcacgggatgtatccgatcgcgtgatctttatggacggcggttatgtagttgaatcaagcccaccagatgagctattcaccaatcccaaagaagcccgtacccaagcgtttttaagcaaagtattgcgctag

SEQ ID NO: 6867 - DNA, 759 bp, Catenulispora acidiphila DSM 44928
atgagcaccgaggccctcgacgccaacgcactgctgcggctgcgcggcgtccacaagcgcttcgacgaccgcaccgtcctggactcgatcgacctcgatgtggccgcacatcaggtggtgtgcctgatcggcggttcgggctcgggcaagtccaccctcctgcgctgcgtcgacctgctggtcgaggtggacgacggcaccatccacctcggcgccaccgagctcaccgacccggccctcgaccagcgcctggcgcgccgtcgcatcggcgtggtgttccaggcctacaacctgttcccgcacctgagcgtgctggacaacgtagccctcgccccgcgccgggtcctgggccgctcgcgggaccaggccgagtccgaggcgatggccctgctgacccgcctgggtctggcagacaaggcccgggactaccccgaccggctgtccggagggcagcagcaacgcgcggcgatcgcccgctccctggcgaccgaacccgaggtcctgctcttcgacgagatcacctcggccctcgaccccgaactggtcggcgaggtcctggacgtggtcgcagacctcaaggaccgcggcttcaccatcctgatggccacccacgagatggacttcgcccggcacgcggccgaccaggtctgcttcctggacaacggcgtcatccgcgaacgcggcgagccggaccagatcctgaccgagccccgggaagccgcgacccaacggtttctggcccggctgctgaaccgttga

SEQ ID NO: 6868 - DNA, 975 bp, Rhodoferax ferrireducens T118
atgtcaagcactatattgcatacatccgggtttacacctagcatctcctcagcggatcaagacagttccccgacatttgtcaaccccgcagaaggggggggggatggtgaaaaaaacccttttctggccgcattgggcgagagagtgcgggctttgcgcgcacgtcgtggcatgacgcgcaaagccctggctatggtggctgacgtgtccgagcggcatctggccaatcttgaatacggtgtgggcaatgcctcaatcctggtgctgttgcaggtggcgggggccttgcagtgctctctgggggagttgattggtgatgtgaccacctcgtcacccgagtggttgatgatccgcgaattgctggaacaacgcgacgatgccaccttgcaacgcgtgcgcattgccattggtgaaatgctgggcactggtggtggcaatgcgggcttgagcccacgtattgcgttgattggcttgcgcggtgccggtaagtccacactggggcagatgctggccgacgacctgggttttccctttgtggagctgagtcgcgagatcgaaaagttcgccggttgcagcgtgtccgaaatccaggcgctctacggggttagtgcctaccggcgctatgagcggcgcgcgctggaagaggccattcagatctaccccgaggcggtgatcgccacgccgggcggcctggtgtcggatgccgccaccttcaatgagctgctggcgcattgcaccaccgtgtggctgcaagccgaccccgaagaccacatgaaacgtgtcacggcccagggcgacctgcgccccatggcggccagcaaggaggccatggaagacctcaagggcatcctgcatggccgcgcccccttctattccaaggcgcaattcaagctcgataccagcgcccagccgctgggccccacttttaatgctttacgcgacatggtgcgcaaggttctgcaacttccggcctga

SEQ ID NO: 6869 - DNA, 984 bp, Burkholderia xenovorans LB400
atgaaccaaaattactctcctgcgtcattggacgattccgccgacgaggatgccggccgcgcggaacgggccacggagcgcggcggcgaacgcgaggaacgcgatcccttcctgacggcgatgggcgaacgcgtgcgcctgctgcgtgcgcgccgcggcatgacccgcaagacgctcgccacggaaaccgggttgtcggagcggcatcttgcgaatctggagtcgggcgtgggcaatgcgtccgtgctggtgctgcggcagattgcggccactttgaactgttcgctcgccgaggtgatcggcgacgaaaccaccgcttccgccgaatggctgctgatccgtgaactgctgcacggacgcgatcaggcggcgttgcagcgcgcccgcatggcgcttgccgaaatgttcgcgcaggcgccgcgcgacccgcatcgcaaggaccggattgcgttgatcggcctgcgcggcgccggcaaatccacgctcgggcgcatgctggcacaggagcgcaaggtgccgttcgtcgagctcacgcgcgtgatcgagcaactggccggctgcccgccgtcggagatccactcgctgtacggggcggccgcttaccggcgttatgaacaccgggcgctcgaggccgtgattcaggagcacgagcatgcggtgattgcgtcgccgggcggcctcgtgtccgagtcgggcacgttcaatacgctgctgtcgcactgctacacggtgtggctgcaagcagcgccggaggaacatatgcgccgcgtcgtcgcgcagggcgacctgcggccgatgtcgggcaacaaggaggcgatggacgacctgaagcgcatcctggcgggacgcagcgagctgtatggccgcgccgacatgagcttcgacaccagcgagaaaaccctggccgacgcctatctgcaactgcgcgaccgtctcgccgcaaggctggccgccgaatcgccggatgaagcgcgtgtgggctga

SEQ ID NO: 6870 - DNA, 999 bp, Polaromonas JS666
atgtcaagcaatatattgcatcaatcagggttaacacttagcgaagtggccactgactttgaaccggtgaagaccgaggccgcgcagctggatggtggggcggcggcgggtaaaaacccgtttctggtggcgctggggcggcgggtggcggccttgcgcgcgcgccgcgggctcacgcgcaaggcggtggccctggccgccgatgtgtccgagcgccacctcgccaacctggaatatggcctgggtaacgcctcaatactggtcctgctgcaggtggccggtgcgcttcagtgttccctggccgaaatcattggcgaccgcaccaccacctcgcccgagtggttgatgatccgcgagctgctcgagcagcgtgatgacgcgacgctcaggcgcgtgcgcatcgtgatcggcgaaatgctgggaaccggcggcggcaatgtcatacgcagtccgcgtattgcattgattgggctgcgtggcgccggcaagtcctcgctggggcagttgttggccgacgacctggggttcccgtttgttgaactgagccgggaaattgaaaaattcgcgggctgcagcgtgtcggaaatccaggcgctctacggcatgaacgcctaccgccgctacgagcggcgcgccctggaggaaaccatccagatctatccggaggcggtgatcgccacgccgggcgggctggtgtcggatccggcgacgtttaaccttttattgagccattgcacgacggtctggctgcaggccacgcccgaggaccacatgcggcgggtgatggagcagggagacctgcgccccatggccaacagcaaggaggcgatggaagacctgaaagacatcctggccggtcgggcacctttttattccaaggcggagttcaccgtgaacaccagcgcgcagcccctgctgccgacttctgctgcgctgcgcgaactggttcgcaatgcccttgacctcccgctggatgaaaaaatcaggaaacatgcataa

SEQ ID NO: 6871 - DNA, 975 bp, Polaromonas naphthalenivorans CJ2
atgtcaagcaatatattgcatgcatcagggttagtccctgatacctccatccttcctcttcaaaccgccgaactgccgcccgccgggcttcaggagccgcaggtggaggaaaaaaatctatttctcgccgccctgggtgaccgggttcgggcgctgcgggcgcggcgcggcatgacacgcaaagccgtgtcgattgcagccgacgtgtctgagcggcatctggcgaacctggagtatggcgaaggcaacgcgtccatcctggtgctgctgcaggtggcccgcgcgctgcactgctcactggccgaactgattggcgatgtgaccacctcgacgcccgaatggctcttgattcgcgaactgctggaaacgcgcgacgatgcctcgctgcgccgcgtgcgcatcgcgattggcgagttgctgggaacgggcagcggcaacaccaccctctgttcgcgcgtggcgctgatcggcctgcgcggggccggaaagtccacgctgggcgccctgctggccgaagacctgggatttccgtttgtcgaactgagccgggaaatcgagaagttcgcgggctgcagcgtctcggaaatccaggcgctctacggcatgaatgcctaccgccgctacgaacgccgggcgctggaagagacgatccagatctacccggaagccgtcattgccacgcccggcggcctggtgtcggacccggccacgttcaaccagctgctgtcccactgcaccaccgtctggctgcaggccgaccctgaagaccacatgaaacgggtgctggcgcagggtgacttgcggcccatggcggccagcaagcaggccatggaagacctcaagggcatcctggcaggtcgtgccgctttctactcgaaggcgcagtacaaggtcgataccagcacccagagcctggagctgtctttccaggccttgcgcgaaatggtgcgcaaggcgcttcagttgccagtttga

SEQ ID NO: 6872 - DNA, 948 bp, Verminephrobacter eiseniae EF01-2
atgaatgaacggcaagaggcgggggcaggtttgtcgacgagcgcatcgccccaggctgcggcgccgaccgatgaggccaagaaccccctgctggtggccctgggcgagcgcgtgcgcaagctgcgcgcgcagcgtggcctgacgcgcaaggccgttgccttggcggctggcatctccgagcgccacctggcgaatctggaatacggcaccggcaatgcgtcgatcctggtgttgcagcaggtggcgggcgcgctgcactgctcgctcgccgagttgcagggcgacttcacgacgcgctcgcccgagtggctgctgatccgcgaactgctggagcaccgcagcgagccgcagttgcgccgcgcgcgcctggcgctgcatgcgctgctcaatggcgcggacgaccccgccaggcacagccgcattgccttggtgggtctgcgcggcgccggcaaatccacgctcgggccgctgctggcgcgcgcgctcgatatgcccttcgtcgaactgagccacgcgatcgaatccctcgccgggtgcagcgtcagggaaatacacaatctgtatggcaccatggcctaccgccgccatgaacgccgggcgctggaagaaacgctgcaaatccacagcgaggtcgtcatcgcgacgcccgggggcatcgtctcggacccggccaccttccagcaactgctggcgcattgcaccaccgtctggttgcgcgccgcccccgaggagcatatggggcgcgtggtggcgcagggggatatgcggcccatggccgacagccaagaggcaatggacgatttgcggcgcatcctcgacggccgcgcagccttctactccaaggccgacatcacgatcgacacctcggggcaaacgcccgatcaaagcctgcaagcgctggtatcgggcgtgcgcaaggccatgggcatgggcagcagcagggattga

SEQ ID NO: 6873 - DNA, 1029 bp, Bradyrhizobium BTAi1
atgagcaggatcagaccccttcagcgccgctcggcgccgccgcaggaccagcgccaggacagcttccccgtggcaggcgaggcggtccccgatcggttcctcagcgagctcggcgcgcgcgtgcgcacgatgcgcgcggtgcgagggatgtcccgcaaggtgctggcccagacctccggcgtgtcagagcgctacatcgcccagctcgaaagtggccagggcaatgtctcgatcatgctgctgcgccggctcgccgaggtcgccggcgtccagctcgaggatctcgttgccgatcccgccggccggccgaaggattgggtgctgatccgcgaactgctgatgcaggcgccgccggtcgtgatcgacgacgtcaaggcgctgctgacgggccgcccgctcgatcggccgacccagactgccaacatccaggtcgatcgcgtcgcgctgatcgggctgcgcggcgccggcaaatcgacgctcggacgattgctggccgagcagctcggctggcgctttgtcgagctcaaccgcgaaatcgagcgggacgccggcttctccgtcagcgaggtgttctcgctctacggccaggacgcctatcgccggttcgagcaggccgcgctggcgcgcatcgtcgcggagcccgggcccatggtgctcgccgtgggcggcggcatcgtgtcggatccggtcaccttcgagcgcctgctcgccgagtacttctgtatctggatcaaggccagcccgaccgagcacatggagcgggtccgtgcgcagggcgatgtccggccgatggccgacgacagcagcgcgatgagcgagctcgtcaccatcctgaagagccgcgaggccctgtacgcgcgggcccgcgcctcgctcgatacgtcgggcgcccgcgtcggggactcggtgcaggcgctgctccggatggtccgcaattattgcaccgccggctgcccctatgtggcccgcaatcgcatcgcggcagcgggcgcgaacgggccggtatgcgaggcggccgcggagcgctag

SEQ ID NO: 6874 - DNA, 915 bp, Delftia acidovorans SPH-1
atggaccagttcgagacggcagcccagtccgccggggcggcggattccctctcagaagcccccaggaaccaggtgctgcaggcgctgggcgagcgtgtgcgcagcctgcgctcgcgccggggcatgacgcggcgcgccctggcggcggcggccgatgtctcggagcgccacctggccaacctcgaatacggcacgggcaatgtgtcggtgctggtcctgcaccatattgcacaggccctgcaatgctccatggccgagctgctgggcgacgtgaccaccaccagcgccgaatggctgctgatccgcgaactgctggaaggccgcaatgaagaggacctgcgccgcgtgcgcctggccgcaggcgagctgctgggcacggcgcccagcgaccgccagcgccacacgcgcatcgcactgatcggcctgcgcggcgcgggcaagtccacactgggccgcatgctggccgagcagctgggcgtgcccttcctcgaactcaaccaggaaatcgagcgcattgccggctgcagcgtgcgcgccatccacgacctgtacggcgccaacgcctaccgccgctacgagcgccgcgcgctggaggaggccgtgcagatctacagcgacgtggtcatcgccacgccgggcggcatcgtctccgacccggccaccttcaacgaactgctgtcgcactgcaccacggtctggctcaaggcccagcccgaggagcacatggcccgcgtcgtggcccagggcgacacccgccccatggccgccaatcccgaggccatggacgatctgcgcagcatcctcgaaggccgcgccggcttctacgccaaggccgaccacgtggtggataccagcggccagacgctggagcagagcttcgaccagttgaaggcactgttcctgcccgcacgctga

SEQ ID NO: 6875 - DNA, 954 bp, Burkholderia phymatum STM815
atgaaccaaacttactccgcggatgcgtctttggctcagcgcgccaacgaagaagcgccgaaagccgagcgcgaagaacgcgatccctttctcaccgcgatgggcgagcgtgtgcgcttgctgcgggcgcgacgcggcatgacgcgcaagacgctggcgtcggagacgggcctgtcggagcgacacctcgcgaatcttgaatcgggcgtgggcaatgcctcggtgctggtgctgcgccagatcgcggcgacgctgaactgtccgctcgccgaagtgatcggagacgaaaccacgtcgtcggccgagtggctgctgattcgcgaactgttgcacggccgcgatcaggccgcgctgcagcgtgcgcgggttgcgttgtccgagatgttcgcgcaggcgccgcgcgacccgcatcgcaaggaccggatcgcgctgatcggcttgcgcggcgcgggcaagtcgacgcttggacgcatgctcgcacaggagcgcaaggtgccgttcatcgagatcacgaaagtgatccagcagatggcgggctgtccgccgtcggaaattcattcgctgtatggcgcgagcgcctatcgacgttacgagcagcgcgcgctggaggcggtgatcggcgagcacgagcgggcggtcatcgcgtcgccgggcgggctggtgtccgaacccgctacgttcaacgcattgctcgcgcactgtttcaccgtgtggctccaggccagtccggaagagcacatgcgccgcgtagtcgcgcagggcgatttgcggccgatgtcgggcaacaaggaggcgatggaagatctgaagcgcatcctcgcgggacgcggcgaactctacaaccgcgctgacatgattttcgacacgagcgagcgcaccctcgccgacgcctatctccagttgcgcgatcgacttgccgcacggttagccgccgaacttggcgacgaaacgtaa

SEQ ID NO: 6876 - DNA, 1125 bp, Burkholderia phytofirmans PsJN
atgcatgcgagtcgtcgcgccatctccgtgacgctgccgaaagttctcaacagcgtttgttattggatcaatatttggcgaaaattaaccgttcacctggtgtctgtcaagcactatagtacatgtatcgaagttaacgggcagcaaaacatgaaccaaaattactcttccgtaccgctggccgactcagccgacgaggacgcgagccgcgccgaacgggtgccggagcgcggcgcagagcgcgatccgtttctcacggcaatgggcgaacgcgtgcgtctgctgcgcgcgcgccgcggcatgacgcgcaagacgttagccgcggaaaccggcctgtcggagcggcatctggcgaatctggagtcgggggtgggcaatgcgtcggtgctggtgctgcggcagatcgcgggcaccttgaactgttcgctggccgaggtgatcggtgacgaaaccacggcctccgccgaatggctgctgatccgcgagctgctgcagggacgcgatcaggcggccttgcagcgcgcccgcgtggcgctcgccgagatgttcgcgcaggcgccgcgcgacccgcatcgcaaggaccggattgcgttgatcggcctgcgcggcgccggcaaatcgacgctcggacgaatgctcgcgcaggagcgcaaagtgccgttcgtcgaactcacacgtgtaatcgagcaactggccggctgcccgccctcggagattcattcgctttatggcgcggccgcttaccggcgttacgaacaccgcgcgctggaggccgtgattcaggaacacgaacgcgcggtgatcgcgtcgccgggcgggctggtgtcggagtcgggcaccttcaatacgttgctgtcgcattgctatacggtgtggctgcaggccgcgccggaggagcacatgcgccgcgtcgtcgcgcaaggcgacctgcggccgatgtcgggcaacaaggaggcgatggacgacctgaagcgcatcctggcggggcgcagcgagctctacgcccgcgccgacatgaccttcgacaccagcgaaaaaaccttggccgacgcctacctgcaactgcgcgaccgcctcgccgcgagactcgctgcggaatcgcccgacgaagcgcggctcggctaa

SEQ ID NO: 6877 - DNA, 951 bp, Variovorax paradoxus S110
atgaacgagcacgtagacgcggtgctggcccccgcgcccgaagaaggccagcgcgccggcaaccccgcggcaccggccggggaggccaagaatccattgctggcggcattgggcgagcgcgtgcgcaacctgcgcgcgcagcgcggcctcacgcgcaaggcggtggccattgcggccgacgtgtcggagcggcatctggccaatctcgaatacggcatcggcaatgcgtcgatcctggtgctgcagcaggtggccggcgcgctgcactgctcgctggccgagctggtcggcgacgtgaccaccagctcgcccgagtggctgctgatccgcgagctgctagagaaccgcagcgaggccgacctgcgccgcgtgcgcgtggccgtgggtgagctgctgggcacggcctcggtcgatccggcgcgccaccgccgcattgcgctcgtgggcctgcgcggcgcgggcaagtcgacgctcgggcagatgctggccgacgacctcgacgtgcccttcgtggaactgagccgcgacatcgagaagctcgcaggctgcagcgtgcgcgagatccacgacctctacggcaccaacgcctaccgccgctacgagcgccgcgcgctcgaggaagccatccagatctacggcgaggtggtcatcgccacgccgggcggcatcgtctcggaccccgccaccttcaacgagctgctcgcgcactgcaccaccgtgtggctgcaggccgcgcccgaggagcacatgggccgcgtggccgcgcagggcgacacccgccccatggccgccagcaaggaagccatggaagacctgcgccgcatcctgaacggccgcgccgccttctattcgaaggccgatctctcggtggacaccagcggcaagacgctggcgcagagcttccaggcgctgcgcacggtggcccgccaggcgatcggcaccggcgcctga

SEQ ID NO: 6878 - DNA, 456 bp, Jannaschia CCS1
gtgacctctggccggttcattgtcttcgtgatccttggggttacggctgttttcggggcgaccctgtggtgggcgaacacgcgcgcctattacgcgcctttggaggttgtcgaaatcgccgtccagcggcctgacggggcgttggtgcccttggagattgtggatgcggaggggattgacgccacaacgtcccccctccgcttccgggcctgtttcacgttgtccgacgatgctcccctcgcggatgccgccccctacgacgatgccacgcccttgatcccgcccgcctggttcgactgcttcgacgccacccaaatcggcgaagcactggaggcgggtgaagcgcaggcctatctgggccaacgcaacgcatcgcgcggcgtggaccgcgtggtggcgatctttcccgacgggcgcggctacgcctggacgcaactcaacggcactttggagtaa

SEQ ID NO: 6879 - DNA, 528 bp, Ruegeria sp. TM1040
atgaccggcaagatcctgtcgatcatcctcatcgtctctggcctcgtggccgggatcgcgatgtattatctgcaagtctacggcttttacgacgaggttgtcgcagagcccggtcgcgatgtggtgctcatgcctatcgggggcgaggcgccgcaggccatcgcctatagcgattttaaggccatcgacgcggacagctcgcccattcgctaccgcgcctgttttgcaacgcctctgaaacccgccgagctggcgcagctctatgagctttccgaggcgcgcgatccgcgcaatgcgccggagtggttcgactgctttgacgctgccgccatcggcgcggccctcaaggacgggcgcgcgcgggcgtttatctctgaaaagaacatcgaatttggtgtcgatcgtatcgtggctgtcaccgaggatggccgaggctacgtctggcacgaactgaacaactgtggcgagaaggcctatgacggcaccatcgtgggcgaggaatgccccaagcggccgcaaagcaactga

SEQ ID NO: 6880 - DNA, 471 bp, Rhodobacter sphaeroides 2 4 1
gtgaatggcaagctcctcgtcggtggcatcgtgctgagcgcgctcgcagccggcgccgtcatgtggtgggcccagctctatgcctattacgaggaggccagcttcgcgccgggtgaggagatccgcctcacgccgatcctcggcgacgcgccggaggcgatcgtcgcgaacgaggtgacggggatcgattccggctcgtcgccgctccggttccgggcctgcttcaccacgcccttgagccaggccatgctgaccgagacctaccgcgtctatcccgatcccacgccgctcaacgcgccgccctggttcgactgtttcgacgccgagcggatcgacatggcgctgcagaagggcgaggccatcgccttcctgtccgaacatgacattgcccccggggtggaccgcgtggtcgcggtctttcccgacggccacgcctttgcgtggcaccagctgaacgccgaggaacagtag

SEQ ID NO: 6881 - DNA, 483 bp, Paracoccus denitrificans PD1222
atgagctcgggcaagatcgtcgcctcgatgctggtgctggtggcggtgatggccggccttgcggtctggtatctgcaggtctacggcttctacgatcaggtggacgagatcagcggcgcgcaggacatcgtcgtcaccgatgcgcagggcgccacccatccggtcgcggtcgcggatttcaaggccatcgacgcgacaagctcgcccatccgctatcgcgcctgcttcacgctggacccggccgaactggccgatgccgcgccctatgccggtgcgacgccgctgaacgggccgggctggttcaagtgctattccgccagggcgctgaccgccgacctggaatcgggtgcggcccgcgccgtgctgggccaggccgagatccgccccgacgtggaccgggttatcgtggtctatcccgacggccgcgcctttgcctggcaccaattcaacgacaagacccccgaacgcggagtgatggactga

SEQ ID NO: 6882 - DNA, 471 bp, Rhodobacter sphaeroides ATCC 17029
gtgaatggcaagctcctcgtcggtggcatcgtgctgagtgcgctcgcagccggcgccgtcatgtggtgggcccagctctatgcctattacgaggaggccagcttcgcgccgggcgaggagatccgcctcacgccgatcctcggcgacgcgcctgaggccatcgtcgcgaacgaggtgacggggatcgattccggctcgtcgccgctccggttccgggcctgcttcaccacgcccttgagccaggccatgctgaccgagacctaccgggtctatcccgatcccacgccgctcaacgcgccgccctggttcgactgtttcgacgccgagcggatcgacatggcgctgcagaagggcgaggccatcgccttcctgtccgaacatgacattgcccccggggtggaccgcgtggtcgcggtctttcccgacggccacgccttcgcgtggcaccagctgaacgccgaggaacagtag

SEQ ID NO: 6883 - DNA, 471 bp, Rhodobacter sphaeroides ATCC 17025
gtgaatggcaagctcctcgcgggtgggatcgtgctgatcgccctgatcgccggggcggcggtctggtggacgcagctccatgcctattacgaggaggtctcctttgaccgcggcaacgagatccgcctgacgccgctcctgggcgaagtgcccgaggtgatcgtggcggacggggtgaaggggatcgacgccgactcctcgccgctgcgctttcgcgcctgcttcaccaccccgctcagccaggccatgctgaccgagacctaccgcgtctatccgacccccacgccgctcaacgcgccgccctggttcgactgtttcgacgcgccgaggatcgacgccgcgctccgccgcggcgaggccatcgccttcctgtccgaacatgacatcgcccccggggtggatcgcgtcgttgcggtctttcccgacggccacgcctatgcgtggcaccagctgaacgccgaggaacagtaa

SEQ ID NO: 6884 - DNA, 477 bp, Dinoroseobacter shibae DFL 12
atgaaccggggcaagctcgtcggcggcgcgatcgtgggctttgccctgatcttcgggatcgtggtctactacacccagatttacgcctattatgaacaggttgatgccgaaaccgtcaccatccgcctgacccccctgggcgggcaggacgcgcccgaaccgatgctggcgaccaacctgcaggcgatcgacggcagctccagccccctgcgcttccgcgcctgtttcgacacgtccgaaagcctcgccttgctgaccgagagctacgtgatccacgacgccgccgtgcccctgaacgcgcccggctggttcgactgcttcgacgccgcacggattggcgcggacctgcgcgacggcacggcgctggccttcctgggcgaggccgagatcgccgatggcgtggaccggatcgtcgccgtgtatcgcgacgggcgcgcctttgcctggcaccaactcaatgaaaaatttgcggactga

SEQ ID NO: 6885 - DNA, 906 bp, Polaromonas JS666
atgggcattagtcagtacatcaaggtcattggtcgtggcaagcagggcgcccgcgcgatcacgcgcgagcaggcagccgacctgttcggccaggtgctggaccgcacggtgaccgatctcgaaattggcggcttttgcctggcgatgcgtatcaagggtgagacgcccgaagagatggcgggctttctggacgccacgtaccagcggctgaatcacctgcccgccaccgagcgacccctggttgtgctcccgagctacaacggtgcccgcaagctgccggtgctcacgcccctgctggcgctgctgctggcgcgcgaaggattgccggtgctggtgcacggcaccgccaccgagtcgagccggatttttgcctcagacgtgctcgcggccctggacatccacgcactgacagcgaccagaaccatagcaagcggcgaggtggcctttgccgccaccgagctgctgtgcccgggactcaagcagttgctggacgtgcggcgtgctgtcggcctgcgcaacccggcgcacagcctggtcaagatcatgaacccctgcctcggcaaaagcctggttgtcagcagctacacgcatcccgagtacgcaatctccatggcgcagacattcgaactcatccaggccaacgcgctgctgctgcgcggcaccgagggcgaagtggtggccgacgcgcgccgcacaccgcagatggaagcctttatcgctggcaaacgcaccctgctgcaggcctcgcagccgggcaccctggccagcgtgccagacctgcccaaagaaatcgacagcgccagtaccgccgcgtatatccgcgcggtcctctcgggtacacatgccgtgcccgcatcgattgcccggcaggtggaacatatcttgcaactggtctcgcaattatga

SEQ ID NO: 6886 - DNA, 927 bp, Acidovorax avenae citrulli AAC00-1
atgggcagcatcagccactacctcaaggacctcggccgcggcgcgcgcggcgcccgcgccatcggccgcgaacaggccgccgatctcttcgggcaggtgctcgacgggcaggtcacagactatgaagtgggcgccttctgcatcgccatgcgcatcaagggcgaaaccgccgacgagatgtgcggtttcctcgacgccacccacgcccgcctcgctcccgttcccgcaggcgaggtgcccaccgtcgtgctgcccagctataacggcgcgcgccggctgcccgtgctcacgccgctgctcgcgctgctgctggcccgcgagggcctgcccgtgctgctgcacggcatgcgcaccgaggcgcgccgcgtgctcgccagcgacgtgctgcaggccctgggcgtggcgcccatggagtcgcccgaggcggtcgcgcccggcagcgtcgcgcacgtccgcacgggcctgctcagcccggggctcgcgcggctgctggcggtgcgcgaggtcgtcggcctgcgcaacccggggcacagcgtggtcaagctcatgaatccggtgcgcggcccgtcgctgctcgtcaccgcctacacccaccccgaatacctggacatgctgcacgccaccttcaccgcgcgcggcatggacgtgctgctctcgcgcggcctggagggcgaagtcgccgccgacccgcgccgcacgccccgttacgacgccttcgtgcgcggcgcgcaccatgtatgggacgagcagcagcccggcaccgcgagcgaggtgcccggcctgcccgcggacatcgacgtggacaccaccgcacgctacacgcagcaggtgctcgcgggcgaactgcccgtgcccgccccgctctcccggcaggtggaacacatcttgcgtcttgcccgccagaactccacggagacagccccatga

SEQ ID NO: 6887 - DNA, 930 bp, Acidovorax sp. JS42
atgggcatcagccactacatcaaggaaatcggccgcggcgcacgcggcgccaaggcactggaccgcgcgcaagccgccgacctgttcgggcaagtgctcgacggccaggtgaccgatctggagatcggcgccttctgcgtggccatgcgcatcaagggcgagaccgccgaggaaatgtgcggcctgctggacgcggtgcatgcgcgcatcaccgccataccggcctgtgcggacgggcagccgctcatcgtgctgcctagctacaacggcgcgcgcaagctgcccgtgctcacgccgctgctggctctgctgctggcgcgcgaaggcctgcccgtgctgctgcacggcatgcgcaccgaggcgcgccgcattctggcatcagatgtgcttgaagcgctggatatacctgcgctaacagctcctcaatccatagcacccggcagcgtggcgcacatcggcaccgcggtgctgctgcccgggctggcgcgcctgctggcggtgcgcgaggtgatcggcctgcgcacaccggggcacagcgtggccaagctgatgaacccctgcgccggcccggcgctggtggtgagcagcttcacacaccccgaatatttcgacatcctgagcggcacctttgccacgctgggcgcgcacgcgttgctgtcgcgcgggctggagggcgaggtggcggccgacccgcgccgcacgccgcgctacgacgccttcattggcggcacgcaccaactgctgcaagaccagcagcccggcacggccgccgaagtgccgggcctgccgaccgagatcgacgtggccaccaccgccgcctatacccggcgcgtgctggcgggcgatgcgcccgtgccccctgccctgcgccagcaggtggaacatatcttgcacttgagccgtcaaatcactgcacaggcctcgtcatga

SEQ ID NO: 6888 - DNA, 906 bp, Polaromonas naphthalenivorans CJ2
atgagcatcagccactacatcaaagaaatcgggcgcggcaaggacggcgcccgtcccctgtcacgcgcgcaggccgccgacctgctgggccaggtgctcgacggcgtggtcaccgacctggaaatcggcggcttttgcctggccatgcgcatcaagggcgaaacccccgaggaaatggctggctttctcgacgccgtgcaccagcgcctcaacctgctgcccgccagcgacggccccaccgtggtgctgcccagctacaacggtgcgcgcaagctgccggtgctcacgccgctgctggcgctgctgctggcccgtgagggcctgagcgtgctggtgcatggaacgcccaccgaatcgagccgtgttttttcatcggaagtgctgtctgcgctaggtacgcaagcgctgacagctatcaaacccatagcacccggcgaagtggtgttcgcgcccaccgaactgctcagtccggcgctcaagcgcctgctcgacgtgcgccgcgcggtcggcctgcgcaatccggcgcacagcctggtcaagctgatgaatccggtggccggcaaggcgctggtcgtcagcagctacacgcatccagaatacgcgctgtccatggcggccaccttcgagctcgtccaggccgatgcgctgctgctgcgcggcaccgaaggcgaaggcgtggccgacccgcgccgctcgccgcagatgcagggctttgtcaagggacagcgcgtgctggcccacgaaggcgtgaagggaaccctgccctccgtgcctgatctacccaaggccatcgacgccagcagcacggcggcctatatccagtcggtgctggcgggcgacagccccctgccgccgtcgattgcgcagcaggtggaacatatcttgcaacttgtcaggcaattatga

SEQ ID NO: 6889 - DNA, 957 bp, Methylibium petroleiphilum PM1
atgggcatcgcgcactacctcaaggaaatcggccgcggcaaggaaggcgcacgttcgctgaccgaggcccaggcccgcgacctgatgaaccaggttctcgaccgcacggtgagcgaggccgagcgcggcgcgttcgcgatcgcgatgcgcatcaagggcgagagcaccgaggagttggctggtttcaccgcctgtgcggccgagcgcagcctggtgctggaggcggatgccatgccggtgctgctgccctcctacaacggcgcacgcaagctgcccaacctcacgccgctgctcgcgctgctgctcgcgcaggagggcgtgccggtgctggtgcacggaccgctgcacgatccggcgcgcgtcaccacctacgaactgttcgagagcctggggctgccgatcgcgcgcgacgccgccggcgtgcacgatgcctgggcgcgccatgagccggtgttcgtgcccaccgcggtgctgtgcccggcgctggtgccgctgctcgaactgcgctgggtgctgggcctgcgcaacccggcacacaccgtggccaagctgctgacgccgcgaggccgcgcctgcctgcgcgtcgtcaactacacgcaccctgagtacgcggccgcgcacacgcgcttcctgcagcacaccggcgcacatgccctgctgatgcgcggcacggagggcgagccggtggccgacgcgcgccgcctgccgaagctcgacatcttcatcgccggcacgccgcggcccgaactcggccgttccgcggtcgagggcgtgctggccgagctgccgctgctgccgcgcagcagcgatgccgcgacgacggcggtctacatccaggcggtggtcagcggagagaagccggtccccggcccgctcgtcgagcaggtcgaggtgctggtccgcgcacacgcggccatgcgacaacacgaggaaagaacccatgagcgctcggcctga

SEQ ID NO: 6890 - DNA, 981 bp, Burkholderia mallei NCTC 10247
atgaccgactccgacgcccacgctaccgaaccgcccgaccactttccgtgcgcccgcctgatcaaggaaatcgggcgcggaccgaatggcgcgcgcgcactgccgtacgacgacgcgttcgcgctgtaccgcgcgatgctcgacggacatgtgtccgacgtcgagctgggcgcggtgctgatcgcctatcggctcaagggcgagacggccgacgagctggcggcgatgctcgccgccgcgcacgcgtcgttcgagccgctgcatgtgcaggacgcgatgttccgcaccgtctcgattccaagctacaacggcgcgcgcaggcagccgaacctcgtgccgctcctcgcgctgctgctcgcgcgcgaaggcgtgccggtgctcgtgcacggcgtgacggaggaccccggccgcgtgacgagcgcggagatcttcgccgagctgacgatcgcgcccggcagcacgcacgacgagatcgaggatacgctcgccgagcgccgcgccgcgttcgcgccgatcgaggtgctcgcgccgaagctcgcgcggctgctcgcgctgcggcgggtgctcggcgtgcgcaattcgacgcacacgatcgtcaagctgctgcagccgttcgagcccgccggcctgcggctcgtcaactatacgcacccgccgtatcgcgacagcctcgtcgagctgtttcgcggccatccggcggccgcggcgggcggcgcgctgctcgcgcgcggcaccgaaggcgaggcggtggccgacacccgccgccaggtgcaggtggactggctgcacgacgggcattgcgagacgatcgtcgagccggcgcgcgcatcgtcggacgcgccgcccgtcgagctgcccgcgtcgcgcgacgccgcgacgacggccgcctggaccgattccgtgatgcgcggcgaaattccggttccggacgcgatcgcgatgcaggtcgacacgatcgtgcggctcgcgcggctcgcatga

SEQ ID NO: 6891 - DNA, 981 bp, Burkholderia pseudomallei 668
atgaccgactccgacgcccacgctaccgaaccgcccgaccactttccgtgcgcccgcctgatcaaggaaatcgggcgcggaccgaatggcgcgcgcgcactgccgtacgacgacgcgttcgcgctgtaccgcgcgatgctcgacggacatgtgtccgacgtcgagctgggcgcggtgctgatcgcctatcggctcaagggcgagacggccgacgagctggcggcgatgctcgccgccgcgcacgcgtcgttcgagccgctgcatgtgcaggacgcgatgttccgcaccgtctcgattccaagctacaacggcgcgcgcaggcagccgaacctcgtgccgctcctcgcgctgctgctcgcgcgcgaaggcgtgccggtgctcgtgcacggcgtgacggaggaccccggccgcgtgacgagcgcggagatcttcgccgagctggcgatcgcgcccggcagcacgcacgacgagatcgaggatacgctcgccgagcgccgcgccgcgttcgcgccgatcgaggtgctcgcgccgaagctcgcgcggctgctcgcgctgcggcgggtgctcggcgtgcgcaattcgacgcacacgatcgtcaagctgctgcagccgttcgagcccgccggcctgcggctcgtcaactatacgcacccgccgtatcgcgacagcctcgtcgagctgtttcgcggccatccggcggccgcggcgggcggcgcgctgctcgcgcgcggcaccgaaggcgaggcggtggccgacacccgccgccaggtgcaggtggactggctgcacgacgggcattgcgagacgatcgtcgagccggcgcgcgcatcgtcggacgcgccgcccgtcgagctgcccgcgtcgcgcgacgccgcgacgacggccgcctggaccgattccgtgatgcgcggcgaaattccggttccggacgcgatcgcgatgcaggtcgacacgatcgtgcggctcgcgcggctcgcatga

SEQ ID NO: 6892 - DNA, 981 bp, Burkholderia pseudomallei 1106a
atgaccgactccgacgcccacgctaccgaaccgcccgaccactttccgtgcgcccgcctgatcaaggaaatcgggcgcggaccgaatggcgcgcgcgcactgccgtacgacgacgcgttcgcgctgtaccgcgcgatgctcgacggacatgtgtccgacgtcgagctgggcgcggtgctgatcgcctatcggctcaagggcgagacggccgacgagctggcggcgatgctcgccgccgcgcacgcgtcgttcgagccgctgcatgtgcaggacgcgatgttccgcaccgtctcgattccaagctacaacggcgcgcgcaggcagccgaacctcgtgccgctcctcgcgctgctgctcgcgcgcgaaggcgtgccggtgctcgtgcacggcgtgacggaggaccccggccgcgtgacgagcgcggagatcttcgccgagctggcgatcgcgcccggcagcacgcacgacgagatcgaggatacgctcgccgagcgccgcgccgcgttcgcgccgatcgaggtgctcgcgccgaagctcgcgcggctgctcgcgctgcggcgggtgctcggcgtgcgcaattcgacgcacacgatcgtcaagctgctgcagccgttcgagcccgccggcctgcggctcgtcaactatacgcacccgccgtatcgcgacagcctcgtcgagctgtttcgcggccatccggcggccgcggcgggcggcgcgctgctcgcgcgcggcactgaaggcgaggcggtggccgacacccgccgccaggtgcaggtggactggctgcacgacgggcattgcgagacgatcgtcgagccggcgcgcgcatcgtcggacgcgccgcccgtcgagctgcccgcgtcgcgcgacgccgcgacgacggccgcctggaccgattccgtgatgcgcggcgaaattccggttccggacgcgatcgcgatgcaggtcgacacgatcgtgcggctcgcgcggctcgcatga

SEQ ID NO: 6893 - DNA, 909 bp, Polynucleobacter necessarius asymbioticus QLW P1DMWA 1
atgagcatcacatcattcttaaaagttattggccgaggcagcaaaggtgccggcgatcttgatcgcaatcaggctaaagaagtattcactcaaattctagatggcaatgtcagcgatcttgagctcggtgcattttgtattgctatgcgcatcaagggtgagtccgtatctgagctcatgggctttatggatgctctgcaaccacatctaaatttactaaatcttggcacacgtccaaccatagtcttaccaagctataacggggctagaaaacaagcaaatctcacaccacttctttccggcatgcttgttagttatggttttacagtgcttgttcagggggtcgaaaaagatcaaaccaggataacgagccatgaaatctttaagtcccttggctggccaattctcaaaacgaaagatgaatttggtgcactcctggcattgaatcaaccgatcttttgctctcttaatgttatttccccagcgcttcaaaagttattagatatcagggagcgaataggtctgcggaatactagtcatgtgctggcaaaactcattaacccaacccttcagaagccttggcaagtttccaactacacacatccagaatatccagaaaaactacgagaattttttcaacttcgctcagccaatgcaattttgattagagggagcgagggtgaaccaactgcctccctgcaacgattacctgaaatgcattttttgcatgcaaatgcgaatgaaattacaacccccgaagagcgctttgaagatctcagtccgtttttagacattgatgccatttcaaccgcatccgttaccgagcaaattctatctgggcaagtcaaatgtccgagctcaattctcagacaagccattcaaatatctacgatggctggattacactaa

SEQ ID NO: 6894 - DNA, 972 bp, Dinoroseobacter shibae DFL 12
atgagcctcgcgtcttatatcgccatcgtggcccgcggcccgggccgtgcgcgaccgttgaccgagacggaggcgcgcgcggccatgggccatgtgctggacggcaccggcgctgcggaggccgtgggcgcgctcctgatgaccctgcggctgcgcggggaaaccgaggacgagatcaccggattcgcgggcgctttgcgcgaccacatgcagcgatggcgcgcgttggacgtcgatctcgattggcccagctactcggcgggacgcacgcgcgggttgccatggtatctgctgagcgcacggctcgtggcccaggcgggctaccgggtgatgctccacgggcgcaatgggggtgatgccgccttgcgcagttatcttgcggcgcaaggtgtggccatcgcgcagactcccgccgcggccaccgcagctctcgacgcgtccggcctcgtctatatcccgctggaggcgctatcgcgtcggaccacggacctgctggcactgcgcgcgcatctgggcctgcgctcctgcgtcaacacgtgtctgcgcgtggcaaacccagcgggcgcccgagtgaccgtccagggcgtgttccacccaccctaccgcgccctgcaggaaaccgcctgcaagcggctcggtgataccgcagcgatgatcatcaaggggggtggcggggagttcgagcgccacccgggcaaagctgtcgtttgccacggccacggaccgaccggtgcctggaccgacgcgccggcgcttctcagagatccgcggcgcctgacggaagtgaccgacaatccggcgcatctgaccgcgctctggaacgggacgtggcatcatccattcgccttggcgaccgtgctcgggactgcggccctggctctttggagcctgggtgccaaccagaccctcgccgatgccgaagcccacgccgcccggctctgggcaacccgctcatcccgccgcgccgcgtaa

SEQ ID NO: 6895 - DNA, 951 bp, Delftia acidovorans SPH-1
atgcccccacaggattccacccacgattgcaacgccatgggcatcagccaatacatcaaggaaataggccgcggcgcacgcggagccaaggcgctggatcgcccgcaggcggccgacctgttcggccaggtgctggacggcggcgtcagcgacctggagatcggggccttttgcatcgccatgcgcatcaagggcgagaccgtcgaggagatgagcggcttcctggacgccgtgcatgcgcgcgtcgcccgttttcccgcctcggccgatggccgccccgtgatcgtgctgcccagctacaacggcgcgcgccgcctgcccgtgctcacccccctgctggccctgctgctggcacgcgaaggcctgcccgtgctgctgcacggcatgcgcaccgaggcgcgccgcatcctggccagcgatgtactgcaggccctgggcattgcgccgctgccatctccccaggccctggccggcggccaggtggcccatatccataccgagcatctgcacctggccctggcgcgcctgctgtccgtgcgcgaggtcatcggcctgcgcaacccgggccacagcgtggtcaagctgctggcgccctgcgacggcccctgcctgctggtgacggcctacacccatcccgagtacctgcccatgctgcacggcaccttcgggacactgggcatgaatgtcctgctctcgcgcgggctggaaggcgaggtcgcggccgacccgcgccggctgccgcgctacgacggctttgtggcaggcgcccaccagctgctggccgagcagcaaagcggcaccgcctccgacgtgccgggcctgcccgccgagatcgacatggacaccacggcgcgctacaccgaagacgtgctcgcgggccggctgcccgtgccgcccgcgctcacacgccaggtggaacacatcgtccaccttgccgatcagattcgctga

SEQ ID NO: 6896 - DNA, 930 bp, Diaphorobacter TPSY uid29975
atgggcatcagccactacatcaaggaaatcggccgcggcgcacgcggcgccaaggcactggaccgcgcgcaagccgccgacctgttcgggcaagtgctcgacggccaggtgaccgatctggagatcggcgccttctgcgtggccatgcgcatcaagggcgaaaccgccgaggaaatgtgcggcctgctggacgcggtgcatgcgcgcatggccgccataccggcctgtgcgggcgggcagccgctcatcgtgctgcccagctacaacggcgcgcgcaagctgcccgtgctcacgccgctgctggcgctactgctggcgcgcgaaggcctgcccgtgctgctgcacggcatgcgcaccgaggcgcgccgcgttctggcatcagatgtgcttgaagcgctggatatacctgcgctaacagctcctcaatccatagcacccggcagcgtggcgcacatcggcaccgcggtgctgctgcccgggctggcgcgcctgctggcggtgcgcgaggtgatcggcctgcgcacaccggggcacagcgtggccaagctgatgaacccctgcgccggcccggcgctggtggtgagcagcttcacccaccccgaatatttcgacatcctgagcggcacctttgccacgctgggcgcgcacgcgttgctgtcgcgcgggctggagggcgaggtggcggccgacccgcgccgcacgccgcgctacgacgccttcattggcggcacgcaccaactgctgcaagaccagcagcccggcacggccgccgaagtgcccggcctgccggccgagatcgacgtggccaccaccgccgcctatacccggcgcgtgctggcgggcgacgcgcccgtgccccctgccctgcgccagcaggtggaacatatcttgcacttgagccgtcaaatcactgcacaggcctcgtcatga

SEQ ID NO: 6897 - DNA, 906 bp, Variovorax paradoxus S110
atgggaatcagccaatacatcaaggaaatcggccgcggcgcgcgaggcgccaagccgctcacgcgcgaacaggccgccgacctgttcggccaggtgctggacggcaccgtcaccgacctggagatcggcggcttctgccttgccatgcgcatcaagggcgaaacgcccgaggagatggcgggtttcctcgatgccacgcatgccaggctcaaccgcctgcccgcggccgaccgcccgctcatcgtgctgccaagctacaacggcgcgcgccggctgccggtgctcacgccgctgctggcgctgctgctggcgcgcgaaggcctgccggtgctggtgcacggcagcgccaccgaaacctcgcgcgtgctggcgtcgaacgtgctggaggcgctggacgtgcccgcgctgcccgccatccgcaagattccttcgggcgaggtgggctttgcgccgaccgagctgctcaaccccgcgctcaagcggctgctcgacgtgcgccgcgtggtgggcctacgcaaccctggccacagcgtggtcaagctgatgcagccgaccaccggcccctgcgtgatcgtggcaagctacacgcatccggaatacgcgcgcaccatgggcgaaaccttcgagctcatgggcatgaccgccctgctctcgcgcggcctcgaaggcgaagtggtgtccgacccgcgccgcactgcgcagatcgacggcttcgtgcgcggcgtgcgcagcgaactgcaggcccaggaaagcggcacggcaagcgaagtgccgggcctgccgaaggagatcgacgtcgcgaccacggccgcgtacacgcggcgtgtgctcgatggcgagcttcccgtgccggaggccatcgcaacgcaggtgaggcacatcacgcaactggcatcccacgcatga

SEQ ID NO: 6898 - DNA, 573 bp, Brucella suis 1330
ttgttccaacgcagatatcctccgacaagatgggagcgcctcaggctttacctgtggccgcgccggtctttctcccgttcgttccggtatgggggcaagagaatcctgcgcattaccgcgtcgccccatgcggtggcggctgggcttgcggtcggcgtcttttccgctttcacgccgtttttcggttttcacctcatcattgcgatcgttcttgcttattttctcgcgggcaatgtcgcggccgccgcgcttggcacgacgcttgccaatccgctgacgctccccttcatctgggggagcaccttcgagcttggccgcttcatcatgagcggcagcgttgatagcgtcccgccggtccatctgggccatgcgctcgaaaccatgcgcttcgaggaggtgtggacgccgcttttgaaaccgatgctgtttggctccaccattctgggggcggcctttgcggtgctggtctatttcgtaacccgctacgccgtttccgtcttccgccgccgccgtctggagcgtctggccgaaaagcatcgcctgcatcgccagcgggagttgcagaaggcatga

SEQ ID NO: 6899 - DNA, 534 bp, Mesorhizobium BNC1
atggtctggcctcgccgttcatatcagcggtcagcgacctacctggtcaagcgcgccctgaggcttagtgccacgccgcatgcgatcgccgcgggcgttgccgccggggtgtttgcctcattcacgcccttcatgggatttcacattatcatcgcagcagcggtagcgtgggtgatccgcggcaatctggtcgcttccgccttgggcacctttgtcggcaatccgctgacctttcccttcatttggggagccacgctcgagacgggcaagtttatcctgcgcggcgaacatccggcaggaataggacctaaggatatcggacacatgctctggcatctggaattcgagaagctttgggagcctttgctgaagccgatggcgatcggttcgctgccgcttggcttgctggcgggattgatcttctactttgtgactcgcggagcgacgaatgcctttcgcgaggaacggcgaaagcggctggcggaaagggcgcggcgccgggccgcgggcggcgcggacgcggtggcatcatga

SEQ ID NO: 6900 - DNA, 603 bp, Bartonella bacilliformis KC583
atgctttttcgtcatcaaaaaccaataaatttgagagagcgtattcggcttttagtttggccgcgtcgttcatttgctcgttcgtttcattacatatgtaaacgtattttacgtatatcagcgactccgcataaggtagcgttagggtttgctattggaattttttcagcgtgttcgccttttttcggtttacatatcattttagcagtatttttttcttggattttacgtggaaactttactgcagcgattattggaactattttttccaatccagttacattttttcccatcatcgtggttgattataaggtaggttacctatttttgtcgttttttgagcatgtagataaaatatctcttgtgcaaattcgtacgatgtttgatggtttgacattttcacaaatatggttagttttctgggagacatgggatttggtgatgataccaatgattttaggcggtgtttttttagggtctattcttggtggtttgttttatataggtgtttacagtggaacggttcgttttcaaaaaaagagataccgaaagataatggaaaaggtgaatttacaccaagaaaatcaaaaaagtgtttcatga

SEQ ID NO: 6901 - DNA, 573 bp, Brucella ovis; identical to SEQ ID NO: 6898

SEQ ID NO: 6902 - DNA, 633 bp, Sinorhizobium medicae WSM419
atgtttcgcccatcgagaggcgggcgggtccgtcttgcgccggcgggcggctttgaatgcgatcatgacggcataatgttattcaggcgcagaaaaccggtcacgatatccgagagacttggcgcgttcttttggccgcgcaaagggttcacgcgcgctccgcgctatattgcccttcgcgttctccgtctgaattcgtcgccgcacgcgatcgctgtcggcgtagcggcaggcgcggcctcctcattaacgccgttcttcggtctgcatatcgttctcgccgtccttctcgcatctgccttttccggaaatctggtcgcggcagcgatcacgaccgtgcttgccaaccccgttaccattcctgtcatcctgacggcctcctacgaggtcggtacgatgcttacgcagccgcaagccgctcaggcggtcggcggtcaggagatcatgcgcatgctcgagcatctggatcttgccagcttgtggggcccggtcttcaagccgatgctcataggctcgcttcctcttgccgcggcgggtggcctgatattctacccgcttgcctttcagacggcgcgtctctttcaggagcgccgccggcgggcccgcgcgcacagacttggacatccaacatga

SEQ ID NO: 6903 - DNA, 576 bp, Ochrobactrum anthropi ATCC 49188
atgctgtttcaacgccgtaatcctccgaccagaaaagagcgcttaaggcttctggtctggccgcgccgctccttctcccgttccttccggtacggtggcaagcggattctgcgcatcactgcctcgcctcatgctgtcgcagctggtttggccgtgggcgtgttttcggcgttcacgcctttctttggcttccatctcatcatcgcaatcgtgctggcctatttccttgccggaaatattgccgccgcggcacttggcacgacgcttgccaatccgctgaccctgccattcatctggggcagcacattcgagctgggccgcttcatcatgaatggaagcatcgacgatgctccgccagttcatctcgggcgggcgctggaaaccatgcatctcgatgaaatctggacgccgcttttgaagccgatgctattcggctcaacgattctgggcgcagcattcgctgtcgtggtctatttcgttacccggtttgccgtctcggccttccgccgtcgccgtatcgaacgccttgccgaaaagcatcgcctgcaccgcgaacaggagcttcagaaagtatga

SEQ ID NO: 6904 - DNA, 591 bp, Rhizobium leguminosarum bv  trifolii WSM2304
atgttgtttcgccgtcgcaagcccgcgggtttcaaggaaaagatgcgagagcttctatggccccgcaaaggtttccttcgcccgctccgttacctgacaatgcgcatcctgcgcctgagcgcttcgccgcatgcggttgcggccggcgtcgctgccggtgtcttcgtctcgtggacgccgttcatcggcgtgcatttcgtcatggccttcgtcatcacctatttcctctccggcagtatggtggccgcagcgctgggttgcgcggccttcggcaacccgctgacctatccgttcatctggggtatcacctgggagatcggacatctgctgctgagccgtgaggatcatctggctggtcaggcggtggatctggccgctctctttcacaggctgaacttcaccgaattgtggaggccggtgctggagccgatgctcgtcggcgccattccgccggggatcgtcacctccgttgcgctctatgcgctgacattctacaccgtgaagggttttcagacgcgccgccacacacggctgctggagcgggcgcgattgcgcctggccagcccggccggcgacctgccgagcgtatga

SEQ ID NO: 6905 - DNA, 591 bp, Rhizobium leguminosarum bv  trifolii WSM1325
atgttgtttcgccgtcgcaaacctgcgggattcaaggaaaagatgcgggagcttttatggcctcgcaagggtttccttcgcccgatccgttacctgacaatgcgcgtcctgcgcctgagcgcttcgccgcatgcggttgccgccggcgtcgctgcgggtgtcttcgtctcgtggacgcctttcatcggcgtgcatttcgtcatggctttcgtcatcacctatttcctctccggtagcatggtggccgccgccctcggctgcgccgccttcggcaatccgctgacctatccctttatctgggggatcacctgggagatcggacatttgctgttgagccgcaaggatcaactggccggtcagacggtggatctcgccgcccttttccacaagctgaacttcactgagctatggaggccggtgctggagccgatgctggtcggcgccatcccgccggcgatcgtcacttccgttgcgctctatgcgctgacgttctacaccgccaggggttttcagacgcgccggcatatacggttgatggagcgggcgcgcctgcgccttgccgttccagccggcaacatgccgagcgtatga

SEQ ID NO: 6906 - DNA, 453 bp, Ralstonia eutropha JMP134
atgaatatgccaattgaaaaaatcaacgaggatattcgttacgttgatgatgacgacgatgtagcggcctgcttcggcttgatgcgccagctacgtcctcatttggctgacgtgaacgaactcatcgcacgctggcgccgccagcagtcggccggctacaggctgatggccgtctgggacgagggtcgtccggtcgcgctggcgggctttcgcctgcaggacaacctggtccacggcgttcacttctatgtcgatgacctggtcaccgacgagtctgcgcgcagcggtgggtacggcgcccggctgatggatcggctcaaaaatgaggcacgcgcgctcggttgcaccaagctggtgctcgatacgccgctcaccaacgtgcttggccaccgcttctattaccgcaacggcctgctcgcctcggcgctgcgtttcaacatcgttctggattga

SEQ ID NO: 6907 - DNA, 450 bp, Burkholderia 383
atgccagagatccatttgaaacgcgccgtgacggacgaggattaccggtcggcgttcgacgtgatgcgcgagctgcgcccgcacctgaccgatgtcgatgcgttcgtgcggcagatgcgccgccaggccgaacagggttacgtgctgctgaccgcgcggcacggcagcccggacggtgcggtcgtcgcgctggcgggataccgtcaccttgaaaacaccgtgtacggccgcttcgtctatgtcgacgatctggtcgcgaccgagcacgcgcgcggtcaacggctgggcgagcggctgctcgatgcggtgcgcaacgacgcgcggcaactcggttgcgcgcaactggtactcgacaccgggctgtccaacgcgctcgcgcagcgcttctatttccgccaggggctgctgtcccgcggcatgcatttcacccagcccctgcaggcgcgctga

SEQ ID NO: 6908 - DNA, 450 bp, Cupriavidus metallidurans CH34 uid250
atgaacggcgtcaccgcggagcagatcgagatccgcggcatcgatacgcccggagacgtggctgcggcgtttcccctgatgcaccagttgcgcccgcatctgcaggacgcggacgagctggtcacgcgttggcagcggcagaccggcgacggctaccgtctggtcggtctgtggaacgatggcccgttggtggcgctggctggctatcggtacgcggaaaacctcgtctatgggccgtactgctatgtcgacgatctggtcactgacgccgccgcgcgcagcggtgggtacggccagatgctgatggactggctgaagacgaaagcgcacgcgcagggatgcgcgcggctggtgctggacacgccgctcgacaatgtgctcggccaccgcttctactaccgcaacggcctgctggcccgggcgctacggttcaactacgtgttcgactga

SEQ ID NO: 6909 - DNA, 483 bp, Pseudomonas putida W619
atgaaattccctttgcacaacttcatacccagcgtgctcgacctggccgacaccgccctgcgtcccttggacagcacccatgacctgtgcagcgcattcccggtaatgcagcaattgcgccctcatctaacgagcgaagccgacttcgtccgccgcatcgagcgtatgcgccttgaaggctatcgcctgattggcgcttatgacgcaggcgttcttgtagcactggctggttatcgcttacaggaaaacctggtctacggcgcattcctgtatgtcgatgaccttgtaaccgccgaggctcagcggggtggccagtgggggtcgcgcttattgcaagccttggaacgactggcgcgcgccagcggttgtgcacgcctggtgctcgacacgggtttggccaacgcccgcgcgcaacgtttctacttccgtgaaggcctgttgacgggtgcactgcgctttcaaaaacagttcgatacgccataa

SEQ ID NO: 6910 - DNA, 450 bp, Ralstonia pickettii 12J
atgaccatggacgccgtccgccccatcgaagatgaagctgccttgcgtgcgtgctttcccgtcatgcaccaactgcggccgcatcttgccgacgccgacgagctggtcgcgcgctggcgccggcaggtgcaagacggctaccgcctcatcgccgtctggcgtgacggggtgccggtagcgctggcgggttatcggcagcaggagaacctcgtctacgggccgttcctgtatgtcgacgatctggtgaccgatgccaacctgcgcagcagcggcctcggcaacgtattgatgagccacctcaaagccgaagccgagcgcctgggctgtgcgcggctcgtgctcgatacgccgctgtccaacgtgcttggccatcgcttctactatcgcaacgggctgcttgcaggcgctttgcgctttggcatgaacacgaaaacgggggctgcgcgatga

SEQ ID NO: 6911 - DNA, 468 bp, Burkholderia phytofirmans PsJN
atgcccgcctcgcttcgcttcgttcacctcgacacgcccgagttactgctccccgcattcgacgtcatgcgtcagttgcgaccgcatctcaccgacgcgcattcgttcgccgcacaggtggccagacagcatgccgacggctatcgcctgctcgctgcttccgacgcgagcggcatcgtcggcctcgccggttatcgcatcctgaccaatctgctgtacggccgcttcgtctatgtcgacgatctcgtggtggatggcaagctgcaacgtgacggcatcggcgcgcaactgctcgacgcggtacggcagattgcgcgcgaagcgggctgcgtgcaattcgtgctcgacacgggtctgcacatgccgcttgcgcagcgcttttatttccgtaacgggctgctcgcgcgaggcatgcacttcgtcgagcccctcgcccctctttcccctgctagcgcgctcacgccatga

SEQ ID NO: 6912 - DNA, 450 bp, Ralstonia pickettii 12D; identical to SEQ ID NO: 6910

SEQ ID NO: 6913 - DNA, 300 bp, Enterobacter sp. 638
atggagagtgtccggcgtagactaaagccactttttaaggagtggaatatgcagcaaaatagccaacccatcgatcgtgagactttgcttattgaagcgaacaaactgattcgtgatcacgaagatactctggcaggaattgaagccaccggcgttgagcaacgtaatggtgtgctggtgttcagcggtgaatactttcttgatgagcaaggtttgcccacccccaagagcacggcagtatttaacatgttcaaatacctggcccatgcgctctcagagaaatatcacctgatcgattaa

SEQ ID NO: 6914 - DNA, 249 bp, Vibrio cholerae O395
atgaaccataaaaaaccgatcactgaatttgaacttttactgattgctaaccaattaattcaagatcatgagtgttacatcgaaggcatgcgtgccactcaagtggaagagaaagaaggcgtgttagtgtttaaaggtgagtatttcctcactgaacaaggccttcctactgagaaaaccacagcggtatttaatatgtttaaatatctcgctcatcatctctcaccggaatttaccctacaaaaataa

SEQ ID NO: 6915 - DNA, 249 bp, Vibrio harveyi ATCC BAA-1116
atgtctgatagaaaatacattgaagaattcgaccttcttttgatcgcaaaccaaatcatccaagagcacgatgactacattgatggtatgcgtgcgacgagcgtagaagaaaaagacgatgtattggtatttaaaggtgagtacttcctcgatgaaaaaggtctaccgaccactaatacaacagcagtattcaatatgttcaaatacctagcgcatcacctttcaaaagagttcacattgaataagtaa

SEQ ID NO: 6916 - DNA, 252 bp, Serratia proteamaculans 568
atgcgcgctgaaacctcacctattgcccgtgaagccctgctggaagaagcaaataatctaattcgtcagcatgatgattatctgcaaggtatggttgccaccgatgttgaacaaaaaggcagcgttttagttttccgcggcgaattctttttggatccggacggattgccaacaataaaaactaccgcagtatttaatatgtttaaacacttggcccacgtgttttctgataaatatcatttagtcgactaa

SEQ ID NO: 6917 - DNA, 252 bp, Yersinia pestis Angola
atgcacgtaaacacaacccctattgaacgtagtaaattattagcagaggccaatgaaattattcgtcaacatgaggattatctgcacggtatgcacgcaacagacgttgaacagaaaggccctgtattagtatttcgcggggaatatttccttgatgctgagggcttaccaacagcgaaaacaaccgccgtatttaatatgttcaaacatctggctcatgtattatccgccaagtaccatttaattgattag

SEQ ID NO: 6918 - DNA, 252 bp, Salmonella enterica serovar Newport SL254
atgcataaagagacgcaacctatcgatcgcgaaacactgttgcttgaagccaacaaaattattcgggaacatgaagacacgatggcaggtattgtcgccaccggcgtaacgcagagaaatggcgtgctggttttcagcggcgattactttttagacgagcaagggttaccgacccctaaaagcaccgcggtgtttaacatgtttaaacacctggcgcatgtgctgtctgagaagtatcacctggtggattaa

SEQ ID NO: 6919 - DNA, 252 bp, Salmonella enterica serovar Heidelberg SL476; identical to SEQ ID NO: 6918

SEQ ID NO: 6920 - DNA, 252 bp, Salmonella enterica serovar Schwarzengrund CVM19633; identical to SEQ ID NO: 6918

SEQ ID NO: 6921 - DNA, 252 bp, Salmonella enterica serovar Agona SL483
atgcataaagagacgcaacctatcgatcgcgaaacactgttgcttgaagccaacaaaattattcgggaacatgaagacacgatggcaggtattgtcgccaccggcgtaacgcagagaaatggcgtgctggttttcagcggcgattactttttagacgagcaagggttaccgacccctaaaagcaccgcggtgtttaacatgtttaaacacctggcgcatgtgctgtctgagaagtatcacctggttgattaa

SEQ ID NO: 6922 - DNA, 252 bp, Salmonella enterica serovar Dublin CT 02021853; identical to SEQ ID NO: 6921

SEQ ID NO: 6923 - DNA, 267 bp, Dickeya dadantii Ech703
atgtccgatttcaattcaattgataaaaaaatgccaatcgcccgcgacgccttgctggccgaggccaatacactgattaaagatcatgaggattatttgaacggcatgtttgccaacgatgtggaacagaaaaacggcgtactgattttccggggggaatattttctggatatcgacggattgccgacaacaaagacaaccgccgtcttcaatatgtttaaacatctggcgcatgttttgtcggaaaaatattacctgaccgactaa

SEQ ID NO: 6924 - DNA, 270 bp, Dickeya zeae Ech1591
atgtctgtttttacacatataaatgaagaaaaaacaccgatcagccgtgaagcattactgcaagaagcgaacacgttgattcagaatcatgacgactacctgcatggcatggtcgccgatgccgtagaacaaaagaacggcgttctggtattccgcggtgaatactttctcgacaacgagggattacccacacagaaaacaacggcggtgttcaatatgttcaaacacctggcgctggtgttgtcagaaaaatatcagttagtcgattaa

SEQ ID NO: 6925 - DNA, 270 bp, Pectobacterium carotovorum PC1
atgtcacctgaacatcaggttaacgaagaaaagcgtcctattgaccgccagagcttattaattgaagccaatgacatcattaaacatcacgatgactatttgcatggcatggtcgctgatagcgtagaacaaaaaaacggcgtgctggtttttcgcggtgagttttttcttgatgataatggaatgccaaccttaaaaagcactgcggtatttaacatgttcaagcatcttgcacatgttttatccgaaaaatattatctgattgattaa

SEQ ID NO: 6926 - DNA, 1173 bp, Escherichia coli BL21 (DE3)
atgaagtttgttgatgaagcatcgattctggtcgttgcaggtgatggcggtaatggttgcgtgagcttccgccgcgaaaagtatattccgaaaggcggcccggatggcggcgacggtggtgatggtggtgacgtatggatggaagccgacgaaaacctgaacacgcttatcgattatcgttttgaaaaatctttccgtgcagagcgcggtcagaacggcgcaagccgcgattgtaccggtaagcgcggtaaagacgtgacgattaaagtgccggtaggtacgcgtgtaatcgaccagggtactggtgaaaccatgggcgatatgactaaacacggtcagcgtctgctggttgctaagggcggctggcacggtctgggcaatacccgtttcaaatcgtccgttaaccgtacaccacggcagaaaaccaacggtacgccgggtgataagcgtgagctgctgctggagctgatgctgctggctgacgtcggtatgttggggatgccaaacgcggggaaatcgacctttattcgcgcggtatcggcggctaaaccgaaagtggcggattatccgtttaccactctggtgccaagtctgggtgtggtacgaatggacaacgaaaagagcttcgttgttgccgatattccaggactgattgaaggcgctgcggaaggcgcaggtctgggtatccgcttcctgaagcacctggaacgttgccgcgtcctgttgcacctcatcgatatcgatccgattgacggcaccgatccggttgaaaacgcgcgtattattatcagcgagctggaaaaatacagccaggatctggcggcgaaaccgcgttggttagtgttcaacaagatcgatctgctggataaggcagaagccgaagagaaagcgaaagcgatcgctgaggcgctgggctgggaagataaatattatctgatctctgcggcgagcggactgggcgtgaaagatctctgctgggatgtgatgacctttatcattgaaaacccggtcgtgcaggctgaagaagcgaaacagccagagaaagtcgaattcatgtgggatgattatcatcgccagcagcttgaagagattgctgaagaggatgatgaggactgggatgacgactgggacgaagacgacgaagaaggcgttgagttcatttacaagcgttaa

SEQ ID NO: 6927 - DNA, 1179 bp, Haemophilus somnus 129PT
atgaaatttattgatgaggcactgattcgtatcgaagctggtgatggcggtaatggctgtgtaagttttcggcgagagaaatttattccgaaaggtggtcctgatggcggtgatggcggtgatggcggcgatgtgtatctaattgccgacgagaatttaaatacattgattgattaccgatttgaaaaacgctttgcagcagagcgtggagagaatgggcgtagttctgattgtacaggacgtagaggcaaagacattacattaagggtaccggtcggaacaagagcaattgataacgataccaaagaagtgttgggtgatttaactaaacatggtaccaaaatgttagttgcaaaaggtggttatcatggactggggaatgcacgtttcaaatcttcagtgaacagagcaccaagacagaaaaccaatggaacaccgggtgaaaagcgagatttgcaattagaattaatgcttttagccgatgttggtatgttgggattacccaatgcaggaaaatcaacatttattcgagctgtttccgcagctaaaccgaaagttgcagattatccttttactacattagttcctagtttaggcgttactcgtgttgatactagccgtagctttgtgattgcagatattcccggattaattgagggggcttctgaaggtgctgggttgggagtacgatttttaaaacatttggagcgttgtcatgtcttaattcatttggttgatattgcaccaattgacgagagtgatccagcggataatattgcaatcattgaaggtgaattatttcaatatagtgaaaaattagcgaataaacctcgttggttagttttcaataaaattgatacactttcagatgaagaagcaaccgcacgtgcaaagaatattatgcaacgtttgggtggggaagatgattattacttgatttcagccgcaacaggtaaaaatgtagacgttttatgccgcgatattatggattttattgaagaaaatccacgtcaagaacaagaaaagatagatgctcaagaagtgaaatttaaatgggatgactatcatcaagaacaattgtccgaacaggtctttacagaagatgaccaagaaggggatgattgggacgattggtcggaagacgatgaggaaggtgtagaaattatttataaaccttag

SEQ ID NO: 6928 - DNA, 1179 bp, Enterobacter sp. 638
atgaagtttgttgatgaagcaacgatcctggttgttgcaggtgatggcggtaatggttgcgtaagcttccgccgtgaaaaatatattcctcgtggtggtcctgacggcggtgatggcggtgatggcggtgatgtgtggttagaggcggatgaaaacctcaacacgctgatcgactaccgtttcgaaaaatctttccgcgccgaacgtggtcagaacggccagagccgtgactgtaccggtaagcgtggcaaagacgtaaccgttaaagtaccggtcggtacgcgtgtgattgaccagggtactggcgagacgttgggcgatatgaccaagcatggtcagcgcttgatggtgggtaaaggcggttggcatggtctgggtaacagccgttttaaatcttctgttaaccgttctccgcgtcagaaaacgatgggtacgcctggcgataaacgcgatctgcagcttgagctgatgctgctggcagacgtgggtatgctggggatgccaaacgcgggtaaatcgacctttatccgttctgtttctgctgcgaaacctaaagtcgcggattatccatttaccacgctggtaccaagcctgggcgttgtccgtatggataacgaaaagagcttcgtagttgctgatattccaggtctgatcgaaggtgctgctgaaggcgctggtctgggtattcgcttcctgaaacaccttgagcgctgtcgtgttctgttgcacctcatcgatatcgatcctatcgacggttcagatccggttgaaaatgcccgtatcatcgttggcgaactggaaaagtatagcgataagctggccgctaaaccgcgttggctggtcttcaacaagatcgacctgatggataaagcggaagctgaagccaaagcgaaagccattgctgaagcgatgggctgggaagataagtactatctgatttcagcggcaagccagatgggtgtcaaagatctttgctgggatgtgatggccttcatcatcgagaacccaattactcaggcagaagaagcgaagcagcccgagaaagttgagtttatgtgggatgactatcaccgccagcagcttgaagaacaagaagttgaagtcgaagatgacgaagagtgggatgaggattgggacgaagacgacgaagaaggtgtcgaattcatctacaaacgttaa

SEQ ID NO: 6929 - DNA, 1173 bp, Yersinia pseudotuberculosis IP 31758
atgaagtttgtagatgaagctgcaatcctggttgtagcaggtgatggtggtaacggttgtgtcagtttccgccgtgaaaagtatatccctaacggtggccctgacggtggtgacggtggtgacggtggcgatatttacctgctggctgatgaaaacctcaacacactgattgattaccgttttgtaaaatctttccgggctgagcgtgggcagaatggtcagagccgcgactgtacaggcaaacgcggtaaagatatcaccatcaaagtcccggttggtacgcgggtgctggatcaaggcactggtgaaattgtcggtgatatggtccgtcatggccagcggctgatggtggccaaaggcggttttcacgggttgggtaacagccgtttcaaatcctcggttaaccgggctccgcgccaaaaaaccatgggaactgaaggtgaaacacgtgagctgatgctggaactgctgttattggccgatgtgggtatgttgggcttacctaatgccggtaaatcgacatttatccgcgcggtttccgccgctaaacctaaagttgctgattatccatttactaccctgattccaagtctgggcgtagtgcgaatggattacgaacagagctttgtgattgccgatattccaggtttgattgaaggtgcttcagatggtgcagggcttggtattcgcttcctgaaacatcttgagcgttgccgggtattattgcacttggtggatttggcgcctattgatgaatcagaccccgctgaaaatgccaaagtaattgttaatgagttgcagcagtacagcgagaaccttgctgagaagcctcgctggcttgttttcaataagattgacctgatagacccagaagaagctgaaaaacgtgctaaggccattgtagaaacgctaggatgggaaggtaagtactacatgatctctgccgcgaatcgcgacaatgtgaatgcattgtgctgggatgtcatgagtttccttaattctcaacctaaagccatggctattgcagaaagcgtgccagagaaagttgagttcatgtgggacgattaccaccgtgagcaactggcggaagttgaagcggaagctgaagacgactgggatgatgattgggatgaagaagatgatgacggcgtagaaattatctacgaacgttaa

SEQ ID NO: 6930 - DNA, 1173 bp, Escherichia coli HS; identical to SEQ ID NO: 6926

SEQ ID NO: 6931 - DNA, 1173 bp, Escherichia coli E24377A
atgaagtttgttgatgaagcatcgattctggtcgttgcaggtgatggcggtaatggttgcgtgagcttccgccgcgaaaagtatattccgaaaggcggcccggatggcggcgacggcggtgatggtggtgacgtatggatggaagccgacgagaacctgaacacgcttatcgattatcgttttgaaaaatctttccgtgcagagcgcggtcagaatggcgcaagccgcgactgtaccggtaagcgcggtaaagacgtcacaattaaagtgccggtaggtacgcgtgtaatcgaccagggtactggtgaaaccatgggcgatatgaccaaacacggtcagcgtctgctggttgctaagggcggctggcacggtctgggcaatacccgtttcaaatcgtcagttaaccgtacaccacggcagaaaactaacggtacgccgggcgataagcgtgagctgctgctggagctgatgctgctggctgacgtcggtatgttggggatgccaaacgcgggtaaatcgacctttattcgtgcggtatcggcggctaaaccgaaagtggcggattatccgtttaccactctggtgccaagtctgggtgtggtacgaatggacaacgaaaagagcttcgttgttgccgatattccaggactgattgaaggcgctgcggaaggcgcaggtctgggtatccgcttcctgaagcacctggaacgttgccgcgtcctgttgcacctcatcgatatcgatccgattgacggcaccgatccggttgaaaacgcgcgtattattatcagcgagctggaaaaatacagccaggatctggcggcgaaaccgcgttggttagtgttcaataagatcgatctgctggataaggcagaagctgaagagaaagcgaaagcgattgctgaagcgctgggctgggaagataaatattatctgatctctgcggcgagtggactgggcgtgaaagatctctgctgggatgtgatgacctttatcattgaaaacccggtcgtgcaggctgaagaagcgaaacagccagagaaagtcgaattcatgtgggatgattatcatcgccagcagcttgaagagattgctgaagaggatgatgaggactgggatgatgactgggacgaagacgacgaagaaggcgttgagttcatttacaagcgttaa

SEQ ID NO: 6932 - DNA, 1173 bp, Serratia proteamaculans 568
atgaagtttgtagatgaagcagcgatcttggtcgttgcaggtgacggtggtaatggttgcgtcagcttccgtcgcgaaaaatatatcccgaacggcgggcctgatggcggtgacggcggcgatggcggcgacgtctatctgttggcggacgaaaacctcaacacgctgatcgactaccgctttgagaaatctttccgcgccgaacgtggccagaatggtcagagccgtgactgtaccggtaagcgtggcaaagatattaccatcaaggttccggtcggtactcgcgtgcaggatcagggcaccggcgaaatcctcggcgacatgacccgtcacgagcagcgtctgatggtggcgaagggcggttggcacggtttgggcaacacccgttttaaatcatccgttaaccgtgctccgcgccaaaaaacgctgggcaccgccggtgaggctcgtgacatcctgctggagctgttgctgctggcggatgtgggtatgctgggcctgccgaacgccggcaagtcgacctttatccgtgcagtctctgctgcaaagccaaaagttgccgactatccgtttaccactctggtgccaagcctgggtgtggtacgtatggatcacgagcaaagcttcgtggttgccgatattccggggctgatcgaaggtgcctccgacggcgctggcctgggtattcgcttcctgaagcatctggagcgctgccgcgtgctgttgcacctggtggatatcgccccgatcgatgaatctgatccggtagaaaacgccaaagtcatcatcaacgagttgaatcagtacagcgagaatctgtcgcagaagccacgctggctggttttcaacaagattgatgtgattggtgaagaagaagctgccgaacgtgccaaggcgattgcagagggcatgggctgggaaggtaagtactacatgatctccgccgtcaatcgtgaaggcgtcaacgcgctgtgctgggatgtgatgaagtttatcaatacccaaccgaaagccatggcaattgaagaaagcgcgccggagaaagtcgagttcatgtgggatgattatcaccgtgaacagatcgctgaagtggaagctgaagcggatgacgactgggatgacgactgggatgaagaggacgacgaaggcgtcgaaatcatttaccagaagtaa

SEQ ID NO: 6933 - DNA, 1173 bp, Escherichia coli C ATCC 8739; identical to SEQ ID NO: 6926

SEQ ID NO: 6934 - DNA, 1173 bp, Escherichia coli SMS 3 5
atgaagtttgttgatgaagcatcgattctggtcgttgcaggtgatggcggtaatggttgcgtgagcttccgccgcgaaaagtatattccgaaaggcggcccggatggcggcgacggcggtgacggcggtgacgtatggatggaagccgacgagaacctgaacacgcttatcgattatcgttttgaaaaatctttccgcgcagagcgtggtcagaatggcgcaagccgcgactgtaccggtaagcgcggtaaagacgtgacgattaaagtgccggtaggtacgcgtgttatcgaccagggtaccggtgaaaccatgggcgatatgaccaaacacggtcagcgtctgctggttgctaagggcggctggcacggtctgggcaatacccgtttcaaatcgtcagttaaccgtacaccacggcagaaaactaacggtacgccgggcgataagcgtgagctgctgctggagctgatgctgctggctgacgtcggtatgttggggatgccaaacgcgggtaaatcgacctttattcgtgcggtatcggcggctaaaccgaaagtggcggattatccgtttaccactctggtgccaagtcttggtgtggtacgaatggacaacgaaaagagcttcgttgttgccgatattccaggactgattgaaggcgctgcggaaggcgctggcctgggcattcgcttcctgaagcacctggagcgttgccgcgttctgttgcacctcatcgatatcgatccgattgacggcaccgatccggttgaaaacgcgcgtattattatcagcgagctggaaaaatacagccaggatctggcggcgaaaccgcgttggttagtcttcaacaagatcgatctgctggataaggcagaagccgaagagaaagcgaaagcgatcgctgaagcgctgggctgggaagataaatattatctgatctctgcggcgagcggactgggcgtgaaagatctctgctgggatgtgatgacctttatcattgaaaacccggtcgtgcaggctgaagaagcgaaacagccagagaaagtcgaattcatgtgggatgattatcaccgtcagcagcttgaagagattgctgaagaggatgatgaagactgggatgacgactgggacgaagacgacgaagaaggcgttgagttcatttacaagcgttaa

SEQ ID NO: 6935 - DNA, 1173 bp, Shigella boydii CDC 3083 94
atgaagtttgttgatgaagcatcgattctggtcgttgcaggtgatggcggtaatggttgcgtgagcttccgccgcgaaaagtatattccgaaaggcggcccggatggcggcgacggtggtgatggtggtgacgtatggatggaagccgacgaaaacctgaacacgcttatcgattatcgttttgaaaaatctttccgtgcagagcgcggtcagaacggcgcaagccgcgattgtaccggtaagcgcggtaaagacgtgacgattaaagtgccggtaggtacgcgtgtaatcgaccagggtactggtgaaaccatgggcgatatgactaaacacggtcagcgtctgctggttgctaagggcggctggcacggtctgggcaatacccgtttcaaatcgtccgttaaccgtacaccacggcagaaaaccaacggtacgccgggtgataagcgtgagctgctgctggagctgatgctgctggctgacgtcggtatgttggggatgccaaacgcgggtaaatcgacctttattcgcgcggtatcggcggctaaaccgaaagtggcggattatccgtttaccactctggtgccaagtctgggtgtggtacgaatggacaacgaaaagagcttcgttgttgccgatattccaggactgattgaaggcgctgcggaaggcgcaggtctgggtatccgcttcctgaagcacctggaacgttgccgcgtcctgttgcacctcatcgatatcgatccgattgacggcaccgatccggttgaaaacgcgcgtattattatcagcgagctggaaaaatacagccaggatctggcggcgaaaccgcgttggttagtgttcaataagatcgatctgctggataaggcagaagctgaagagaaagcgaaagcgattgctgaagcgctgggctgggaagataaatattatctgatctctgcggcgagtggactgggcgtgaaagatctctgctgggatgtgatgacctttatcattgaaaacccggtcgtgcaggctgaagaagcgaaacagccagagaaagtcgaattcatgtgggatgattatcatcgccagcagcttgaagagattgctgaagaggatgatgaggactgggatgatgactgggacgaagacgacgaagaaggcgttgagttcatttacaagcgttaa

SEQ ID NO: 6936 - DNA, 1173 bp, Salmonella enterica serovar Newport SL254
atgaagtttgttgatgaagcatcgattctggtcgttgcaggcgatggcggtaatggctgtgtgagcttccgccgcgaaaaatatatcccgaaaggcggcccggacggcggtgatggcggcgacggcggcgacgtctggatggaagccgatgaaaacctgaatacgctgatcgattaccgctttgaaaaatcgttccgcgctgaacgtggtcagaatggcgcgagccgcgactgtaccggtaaacgcggtaaagacgtgaccatcaaagtgccggtcggtacgcgcgttatcgaccagggaaccggtgaaacgatgggcgacatgaccaaacacggtcagcgtctgttggtcgcgaagggcggctggcatgggttaggcaatacccgttttaaatcctcggttaaccgtacgccgcgccagaaaaccaatggtacgccgggcgataagcgcgacctgctgctggaactgatgctgctggcggatgtcgggatgctggggatgccaaacgccggtaaatcaacgttcattcgcgcggtatcggcagcaaaaccgaaagtcgcggactatccgtttaccacgctggtgccgagcctgggcgtggtacgtatggacagcgaaaagagttttgtggtggccgacattccggggttgatcgaaggcgcggcggaaggcgcgggcctggggattcgcttcctgaagcacctcgaacgttgccgcgtactgctgcacctcattgatatcgatccgatcgacggttccgatccggtggaaaacgcccgtatcattattggcgaactggaaaaatacagccaggatctggcggctaaaccgcgctggttagtgttcaacaagatcgatctgatggataaaaccgaagcggaagagaaagcgaaagcgatcgccgaagcgttgggctgggaagggaaatactatctgatttccgccgccagccagctaggggtgaaagatctctgctgggatgtgatgacctttatcatcgagaatccgatcgcgcaggctgaagaagcaaaacagccggaaaaagtcgagttcatgtgggacgattatcatcgtcagcagttggctgaagtggaagaagacgcagacgatgactgggatgacgactgggatgaagacgacgaagaaggcgtcgagttcatctacaaacgttaa

SEQ ID NO: 6937 - DNA, 1173 bp, Salmonella enterica serovar Heidelberg SL476
atgaagtttgttgatgaagcatcgattctggtcgttgcaggcgatggcggtaatggctgtgtgagcttccgccgcgaaaaatatatcccgaaaggcggcccggacggcggtgatggcggcgacggcggcgacgtctggatggaagccgatgaaaacctgaatacgctgatcgattaccgctttgaaaaatcgttccgcgctgaacgtggtcagaatggcgcgagccgcgactgtaccggtaaacgcggtaaagacgtgaccatcaaagtaccggtcggtacgcgcgttatcgaccagggaaccggtgaaacgatgggcgacatgaccaaacacggtcagcgtctgttggtcgcgaagggcggctggcatgggttaggcaatacccgttttaaatcctcggttaaccgtacgccgcgccagaaaaccaatggtacgccgggcgataagcgcgacctgctactggaactgatgctgctggcggatgtcgggatgctggggatgccaaacgccggtaaatcaacgttcattcgcgcggtatcggcagcaaaaccgaaagtcgcggactatccgtttaccacgctggtgccgagcctcggcgtggtacgtatggacagcgaaaagagttttgtggtggccgatattccggggttgatcgaaggcgcggcggaaggcgcgggcctggggattcgcttcctgaagcacctcgaacgttgccgcgtactgctgcacctcattgatatcgatccgatcgacggttccgatccggtggaaaacgcccgtatcattattggcgaactggaaaaatacagccaggatctggcggctaaaccgcgctggttagtgttcaacaagatcgatctgatggataaaaccgaagcggaagagaaagcgaaagcgatcgccgaagcgttgggctgggaagggaaatactatctgatttccgctgccagtcagctaggggtgaaagatctttgctgggatgtgatgacctttatcatcgagaatccgatcgcgcaggctgaagaagcaaaacagccggaaaaagtcgagttcatgtgggacgattatcatcgccagcagttggctgaagtggaagaagacgcagacgatgactgggatgacgactgggatgaagacgacgaagaaggcgtcgagttcatctacaaacgttaa

SEQ ID NO: 6938 - DNA, 1173 bp, Salmonella enterica serovar Schwarzengrund CVM19633
atgaagtttgttgatgaagcatcgattctggtcgttgcaggcgatggcggtaatggctgtgtgagcttccgccgcgaaaaatatatcccgaaaggcggcccggacggcggtgatggcggcgacggcggcgacgtctggatggaagccgatgaaaacctgaatacgctgatcgattaccgctttgaaaaatcattccgcgctgaacgtggtcagaatggcgcgagccgcgactgtaccggtaaacgcggtaaagacgtgaccatcaaagtgccggtcggtacgcgcgttatcgaccagggaaccggtgaaacgatgggcgacatgaccaaacacggtcagcgtctgttggtcgcgaagggcggctggcatgggttaggcaatacccgttttaaatcctcggttaaccgtacgccgcgccagaaaaccaatggtacgccgggcgataagcgcgacctgctgctggaactgatgctgctggcggatgtcgggatgctggggatgccaaacgccggtaaatcaacgttcattcgtgcggtatcggcagcaaaaccgaaagtcgcggactatccgtttaccacgctggtgccgagcctgggcgtggtacgaatggacagcgaaaagagttttgtggtggctgacattccggggttgatcgaaggcgcggcggaaggcgcgggcctggggattcgcttcctgaagcacctcgaacgttgccgcgtactgctgcacctcattgatatcgatccgatcgacggttccgatccggtggaaaacgcccgtatcattattggcgaactggaaaaatacagccaggatctggcggctaaaccgcgctggttagtgttcaacaagatcgatctgatggataaaaccgaagcggaagagaaagcgaaagcgatcgccgaagcgttgggctgggaagggaaatactatctgatttccgccgccagtcagctgggggtgaaagatctctgctgggatgtgatgacctttatcatcgagaatccgatcgcgcaggctgaagaagcaaaacagccggaaaaagtcgagttcatgtgggacgattatcatcgccagcagttggctgaagtggaagaagacgcagacgatgactgggatgacgactgggatgaagacgacgaagaaggcgtcgagttcatctacaaacgttaa

SEQ ID NO: 6939 - DNA, 1173 bp, Salmonella enterica serovar Agona SL483
atgaagtttgttgatgaagcatcgattctggtcgttgcaggcgatggcggtaatggctgtgtgagcttccgccgcgaaaaatatatcccgaaaggcggcccggacggcggtgatggcggcgacggcggcgacgtctggatggaagccgatgaaaacctgaatacgctgatcgattaccgctttgaaaaatcgttccgcgctgaacgtggtcagaatggcgcgagccgcgactgtaccggtaaacgcggtaaagacgtgaccatcaaagtgccggtcggtacgcgcgttatcgaccagggaaccggtgaaacgatgggcgacatgaccaaacacggtcagcgtctgttggtcgcgaagggcggctggcatgggctaggcaatacccgttttaaatcctcggttaaccgtacgccgcgccagaaaaccaatggtacgccgggcgataagcgcgacctgctgctggaactgatgctgctggcggatgtcgggatgctggggatgccaaacgccggtaaatcaacgttcattcgtgcggtatcggcagcaaaaccgaaagtcgcggactatccgtttaccacgctggtgccgagcctgggcgtggtacgtatggacagcgaaaagagttttgtggtggccgacattccggggttgatcgaaggcgcggcggaaggcgcgggcctggggattcgcttcctgaagcacctcgaacgttgccgcgtactgctgcacctcattgatatcgatccgatcgacggttccgatccggtggaaaacgcccgtatcattattggcgaactggaaaaatacagccaggatctggcggctaaaccgcgctggttagtgttcaacaagatcgatctgatggataaaaccgaagcggaagagaaagcgaaagcgatcgccgaagcgttgggctgggaagggaaatactatctgatttccgccgccagtcagctgggggtgaaagatctctgctgggatgtgatgacctttatcatcgagaatccgatcgcgcaggctgaagaagcaaaacagccggaaaaagtcgagttcatgtgggacgattatcatcgccagcagttggctgaagtggaagaagacgcagacgatgactgggatgacgactgggatgaagacgacgaagaaggcgtcgagttcatctacaaacgttaa

SEQ ID NO: 6940 - DNA, 1173 bp, Escherichia coli O157 H7 EC4115
atgaagtttgttgatgaagcatcgattctggtcgttgcaggtgatggcggtaatggttgcgtgagcttccgccgcgaaaagtatattccgaaaggcggcccggatggcggcgacggcggtgatggtggtgacgtatggatggaagccgacgagaacctgaacacgcttatcgattatcgttttgaaaaatctttccgtgcagagcgcggtcagaatggcgcaagccgcgactgtaccggtaagcgcggtaaagacgtcacaattaaagtgccggtaggtacgcgtgtaatcgaccagggtactggtgaaaccatgggcgatatgaccaaacacggtcagcgtctgctggttgctaagggcggctggcacggtctgggcaatacccgtttcaaatcgtcagttaaccgtacaccacggcagaaaactaacggtacgccgggcgataagcgtgagctgctgctggagctgatgctgctggctgacgtcggtatgttggggatgccaaacgcgggtaaatcgacctttattcgtgcggtatcggcggctaaaccgaaagtggcggattatccgtttaccactctggtgccaagtctgggtgtggtacgaatggacaacgaaaagagcttcgttgttgccgatattccaggactgattgaaggcgctgcggaaggcgcaggtctgggcattcgcttcctgaagcacctggaacgttgccgcgtcctgttgcacctcatcgatatcgatccgattgacggcaccgatccggttgaaaacgcgcgtattattatcagcgagctggaaaaatacagccaggatctggcggcgaaaccgcgttggttagtcttcaacaagatcgatctgctggataaggtagaagccgaagagaaagcgaaagcgatcgcagaggcgctgggctgggaagataaatattatctgatctctgcggcgagtggactgggcgtgaaagatctctgctgggatgtgatgacctttatcattgaaaacccggtcgtgcaggctgaagaagcgaaacagccagagaaagtcgaattcatgtgggatgattatcatcgccagcagcttgaagagattgctgaagaggatgatgaggactgggatgacgactgggacgaagacgacgaagaaggcgttgagttcatttacaagcgttaa

SEQ ID NO: 6941 - DNA, 1179 bp, Dickeya dadantii Ech703
atgaagtttgtagatgaggccaccattcttgtcgtggctggtgacggtggcaacggctgcgtcagtttccgccgtgagaaatatatccctaatggcgggccggacggcggcgacggcggcgacggcggcgacgtgtacctgctggctgatgagaacctcaataccctgattgattaccgtttcgagaaatcgtttcgcgctgaacgtgggcagaatggtcagagccgtgactgtaccggtaaacgtggcaaggatattgtcatcaaagttccggtaggcacacgaattcgtgataaaggcacggacgagatccttggcgatatgacacgtcatcagcagcgtttgctagtcgccaaggggggctggcatggattagggaatactcgcttcaagtcatcggtgaatcgtgctccgcgtcaaaagactagtggtacgccaggagaagaacgagagttattgctggaattgctgttgttggcggatgtcggcatgctggggttgccaaatgccggtaaatctacatttatccgggctgtctccgctgccaagccgaaagtggctgattatccgtttacgacgctggttcctagtctgggcgtggttcgtatggatagcgagcaaagttttgttattgccgatattcccggattaatcgaaggtgcatccgaaggcgccggtctggggatccgttttctccgtcatctggagcgttgtcgtgttttgttgcacctgatcgatctggcgcctatggatgaatctgatccgatccagaatgccaaggtgatcgtgaatgagttgcatagttatagcgcaacattggctgagaaacctcgctggttggtattcaacaaggtggatctactggatcacgctgaaggcgaaaagcgggctaaagagattgccaatgctttggggtgggaaggtaaatattacctggtgtccgcggccaatcgcgcaggcgtgaatgcgctatgctgggatgtcatgagtttcctcaacgccaatcccaaaatcatggaaacggaagagggagctgcagcatcccaaaaggtcgagttcatgtgggatgattatcatcgtgagcaactggaatctgctgacgaggatatggaagaggatttggatgatgactgggatgaagacgatgacgaaggcgttgaaattatctatcagcgttaa

SEQ ID NO: 6942 - DNA, 1176 bp, Dickeya zeae Ech1591
atgaagtttgtagatgaagccaccattctggttgtggcaggtgacggtggcaacggctgtgtcagcttccgtcgtgaaaaatatattcccaacggtgggcctgatggtggcgacggcggcgatggtggcgatgtctacctgctggcggatgaaaacctcaataccctgattgactatcgttttgagaaaagcttccgtgccgaacgtgggcagaatggtcaaagtcgtgattgcaccggcaaacgcggtaaagatatcaccattaaagtgccggtcggtacgcgtatactggataaaagcaccggcgaagtgctgggtgatatgacccgtaatcagcagaaactgatggtcgctaaaggcggatggcacgggttgggtaatacccgtttcaaatcctctgtgaatcgtgcgccgcggcagaaaaccaacggtacgccgggcgaagaacgcgagttgctgctggagttgctgctactggcggatgtaggcatgttagggttgccgaatgccgggaaatcgacctttatccgcgcggtatccgcagctaagccgaaggtagcggattatccgtttactacgttggtgccgagcctgggcgtcgtacgtatggacagcgagaaaagctttgtcgtggcggacattccaggattgattgaaggcgcatccgaaggcgcagggctcgggatccgtttcctgaaacatctggagcgttgtcgcgtgctgctgcacttgatcgatctggcgccgatcgatgaatccgatccgatcgaaaacgccaaagtgatcgtcaatgaattgcagcaatacagtgcgtctctggcggagaaacctcgctggctggtattcaacaaagttgacatgctggagaaaggcgaggctgaaaaacgtgcgaaggcaattgccgccgcgctgggttgggaaggcaaatattatctaatttcggcggccaaccgtgaaggggtgaacgccctgtgctgggatgtcatgaatttcctcaatactcagccgaaagcgttggccgaagtagagaacaaagcgcctgaaaaagtggactttatgtgggatgactaccaccgggagcagttggaagccgtacaggccgaagccgaagaagagtgggatgacgattgggatgaagatgacgacgaaggcgtcgaaattgtttatcagcgttga

SEQ ID NO: 6943 - DNA, 1173 bp, Pectobacterium carotovorum PC1
atgaagtttgtagatgaagccacaattctcgttgtggcaggcgatggcggtaacggttgtgttagctttcgccgtgaaaaatatattcctaacggcggcccagatggcggtgacggcggtgatggcggcgacgtttatctgctggctgacgaaaacctgaacacgctgattgactatcgttttgaaaaatccttccgcgctgagcgtggacaaaacgggcaaagtcgcgactgtacgggtaaacgcggtaaagatattacgattaaagtccctgttggtacccgtgttctggatcagggtaccggcgaggtgttaggcgatatgacgcgccatcagcagagcctgatggtcgcgaaaggcggctggcacggtttaggtaacacgcgttttaaatcatccgtcaaccgtgctcctcgccagaagactagtggcacgaaaggtgaagaacgtgagctgacgctggaactgctgttgctggctgacgtgggaatgttgggtctgccgaacgcaggcaaatcgactttcatccgtgcggtatcagcagcgaagccaaaagtcgccgattatccgtttactacactggtgccgagccttggtgtggttcgcatggacagtgaacagagctttgttgtggcggatatccctggtttgattgaaggggcatccgaaggcgctgggttaggtattcgtttcctgaaacaccttgaacgctgccgtgttctgctgcatttggttgatctggcaccgattgatgagtccgatccggttgaaaatgctaaaatcattatcaacgagttagagcagtacggcgcaggtttagcagaaaaaccgcgttggctggttttcaacaaagtggatttgatcgacaaggctgaagcggaaaaacgagccaaagagattgcgactgcgcttggctgggaaggtaagtattacctgatttctgcagcgaaccgtgaaggcgtcaccccactttgctgggacgtaatgagcttcctgaaagctaatccgaaagtgacggcgattgccgaaagcgcgccggaaaaagttgagttcatgtgggatgattatcatcgtcaacagttggctgaaatagaaaaagaagccgaagaagagtgggatgatgattgggacgatgaagatgatgaaggcgttgagattatctatcaaaagtaa

SEQ ID NO: 6944 - DNA, 399 bp, Escherichia coli BL21 (DE3)
atgacctgggaatatgcgctaattgggttagtcgtcggcatcattattggtgctgtggccatgcgttttggtaatcgtaaactacgccagcaacaggcgttgcagtacgaactggaaaagaataaagctgaactggacgagtatcgcgaagagctggttagccactttgcccgcagcgcggaattactggataccatggcgcacgactatcgccagctgtatcagcacatggcaaaaagctccagcagcctgctgccggaactgtctgctgaagcaaacccgttccgtaatcgtctggcagagtctgaagccagcaacgatcaggcaccggtgcagatgcctcgcgactattctgaaggcgcatccggcctgctgcgtactggcgcgaagcgcgactaa

SEQ ID NO: 6945 - DNA, 456 bp, Colwellia psychrerythraea 34H
atgaatgtagtaatagctctagtcatttttatcatcggcggcatcggtggttttttcgcaaatcgtcttctttctagtacaagccaagagcaacgtaaattagcggaccaagtcaataaaagtgaagcagctttagatcaatacaagttagatgttgccgagcatttagacagctcagccaaattacttgaccaaatgaataacacttgtcaaacagccatgaagcaaatgaaagaaagtactcagttattgcaaaaagcaactacagtagaagctgaaggtatgccatttttctctgctgaaactcagcaacaactagcacaaacggcgactttacgtcaccaaaagcgcgctagtgaagcagttgaagccatgactgaagcaccgcttgattattcaggaaacccaagtggtttatttgccgaccagaaacaaaaagttacaactacagtgtaa

SEQ ID NO: 6946 - DNA, 459 bp, Saccharophagus degradans 2-40
atggttggtgctattgttttatgtattggcggcttaataggcgctgttatcagccgcaaatttattccaccagagcaccaaaaagaactggagacaaaccttcaggcggcacgtgaagacttaaagcaatatcaacaggatgtagcgcaacactttgaagaaacttctcgcttggtacacaacctcactcaaagttacaaagaggttcacgaacatttagctaaaggcgctattcacctaaccaactcagatattagccgccaaatgcttgaagctggcgatggcaatattggtgttgaggctggcgcactgttagccgaaaccactgtactgccgccacgcgactgggcaccaaaaaccccagggcaaaaaggcacattaagtgaagagtttggcttgcttgatgaagccgaagcagaaaacgcagaaaaacctaaagaggaaaaagaaataaactga

SEQ ID NO: 6947 - DNA, 522 bp, Chromohalobacter salexigens DSM 3043
atggccccaggctcggtatgccctcgtactgcacaccgcatgcccgtgacattcaaggagagcattgtgaacgagagcaacatcgactggatcctggccatcgcttgctttctggcgggcatcggcgtcggcgccctcggctaccatttgctgaacgccaacgtggcgcgcaatcagaaagtccgccaacgcctggctgaagccgaactggagctcagccaggtcaaggatgcgctgaacgatcacttcaccaaggccgccgacctggtgaccagcattcagcgtcagagccatgagctcgaacagcaactggcacaaggggccgaccgcctcgtcgacgatctgcagctgaagcggcgcctgcaccaaggtcaggatgacgccgtcaccgacgacgacaccgactctccccaggtgccacgcgactacgcagaaggcgctcaaggcaccctggccgaaaactacgggctggagtcacacaagcggcgcgagaccgaagaaccggcaccgcctcgctactga

SEQ ID NO: 6948 - DNA, 438 bp, Marinobacter aquaeolei VT8
atgacaaacctgattctggcggcagttgccgcgttggtagttggcattgtcatcgggattctggttggccgttccggccagggagcaacgttgcggcagcgccgggcggagcagcagattgaagagctgcgcagcgagtttacgcgctatcaggcccaggtgaacgagcactttatggaatccgcgcacctgttgcgccggttcaacgacgcctaccgggatgtgaaccagcatatggctcgtggcgccaaccgtctgtgcaatgacgaagactggatggaagagctggatcagaaatccaagggcagactggagcatggcagtgatggcgagccttcagaacctcccagggattatgcacccaaggccgaccctgaggccaaaggaacgcttgccgaggactacggcctggacaagggcgagaagcgcccggcttga

SEQ ID NO: 6949 - DNA, 399 bp, Enterobacter sp. 638
atgacctgggaatatgcgctaattggtttagtcgtcggcatcgcaatcggtgctgtagccatgcgtttcggtaatcgcaaattgcgtcagcagcagtcgttacaatacgaactggaaaaaaacaaagctgaacttgaagagtatcgtgaagagctggtcagccactttgcccgtagcgccgagctgctggacaacatggccaccgactatcgtcagctgtatcaacatatggcaaaaagctccagcaaccttctgccggagatgagtgctgaaagcaacccgttccgcaaccgtctggctgagtccgaagccagcaacgatcaggtgccagtacagatgccgcgtgattactcagacggtgcatccggcctgctgcgcggtggcgtaaaacgcgattaa

SEQ ID NO: 6950 - DNA, 438 bp, Vibrio cholerae O395
atgccttggatctatgccattgctggattgctagtggggattgctgtcgggatgctgattgctcgtttgactacccctcaatataagacgcagaagaacctgcaaaaagaactcgagagcgcaaaattcaccttagagcagcagcgccaagaactgtctgatcactttgcgcagacagcagaaatgctcgataccctgggaaaagattacactaagctgtatcaacacatggcgaaaaccgctaccgatttgatccccaatttacctgagcaagataacccattcagtaaattggctcagcaaaaagaagagagcaaacagccagaagagctcgaacaaccacctaaagattacgcattgggtgccacaggacttttgcgcggtgaagaaaaagcaatcattcgctcagcggatttgcttaacgccaaagccagctaa

SEQ ID NO: 6951 - DNA, 456 bp, Marinomonas MWYL1
atgaacttagaagaattcaacatcattatctttattaccggcatcattattggctgtgtcgctacacttgctcttaaaagctacagtgcaaaaaataacagcaaaaaagctgattcaagctcaaacatcattacgatgaagtcactacagcaagaattagacagcaagcaagttattatcgacaacttcttcactgacagtaatgaacacttaatgtccgcagaaaagcgcttagcagacctaagaaacactcttgcagataacgcaactcaattaagcaacataaaaattgaaagaagcactgccacttcaaacaataccgatactattgagcctgcttctttcgaaccaccaagagactacgcactaaaaaatgataaagaaccaggcacattgagtgaatcattcggtcttgatgatagaaatatagaccttgaaccaaagcgcactatttaa

SEQ ID NO: 6952 - DNA, 405 bp, Yersinia pseudotuberculosis IP 31758
atgacctgggagtatgcgcttattggattggttgttggtgttgtgatcggcgcggtggctatgcgctttggcaaccgcaaattgcgtcagcaacaagtgctgcaaaatgagctggagaagagcaaaacagatttggaagagtatcgtcaagagctggttgggcacttcgcacggagtgccgagttactggataacatggcccgtgattatcgtcagctttatcaacatatggcgaaaagctccaataacttattaccggacttaccattacaggataatccgttccgttaccgtctgacagaatccgaagcggataatgatcaggcacccgttaaactgccacctcgtgattactctgaaggcgcatctggtttattacgcccggaacaccagaatcgcgattaa

SEQ ID NO: 6953 - DNA, 444 bp, Vibrio harveyi ATCC BAA-1116
atgccttggatttatgccattgtgggtttgctggtcggtacaatcgttggcgtagtcattagtcgactaaccacccccgaatacaaaaaacaaaagtctgtgcaaaaagaactcgaagcagccaagtttgaactagagcaacaacgtcaagagctcgtcgatcactttgcacaaactgcagaaatgttggataccttaggtaaagattacactaagctataccaacatatggcgaaaacgtcttcagaacttctacccaacttgcctgagcaagataatccgtttgataagaagacagcaatgtcgactgaatcgatcgaagaagaccaatcagacgtcagcgaacaaccaaaagactatgccaacggcgcaaccggtcttttgaaggatcaggcaaaagaaatcatcgacgcaccagaagctgtcacggctaaagcgtcttaa

SEQ ID NO: 6954 - DNA, 399 bp, Escherichia coli HS; identical to SEQ ID NO: 6944

SEQ ID NO: 6955 - DNA, 399 bp, Escherichia coli E24377A
atgacctgggaatatgcgctaattgggttagtcgtcggcatcattattggtgctgtgaccatgcgttttggtaatcgtaaactacgccagcaacaggcgttgcagtacgaactggaaaagaataaagctgaactggacgagtatcgcgaagagctggttagccactttgcccgcagcgcggaattactggataccatggcgcacgactatcgccagctgtatcagcacatggcgaaaagctccagcagcctgctgccggaactgtctgctgaagcaaacccgttccgtaatcgtctggcagagtctgaagccagcaacgatcaggcaccggtgcagatgcctcgcgactattctgaaggcgcatccggcctgctgcgtactggcgcgaagcgcgactaa

SEQ ID NO: 6956 - DNA, 402 bp, Serratia proteamaculans 568
atgacctgggagtatgcgctgattggtttggtggtcggtatcgtcattggtgcggtagcgatgcgttttggtaaccgtaaattacgtcaacaacaagttttgcagaacgagttggacaagagcaaaaccgatcttgaagagtatcgccaggagctggtcggccactttgcccgcagcgccgagctgctggacaatatggcacgcgactatcgccagctgtatcagcacatggcgaaaagctccaacaacctgctgccggacctgccaatgcaggaaaacccgttccgctatcgcctgaccgaagccgaagcggataacgatcagacgccggtagagatgccgcgcgactactcagaaggcgcatccggcctgctgcgtggcgaacgtccgcgccgcgactaa

SEQ ID NO: 6957 - DNA, 405 bp, Yersinia pestis Angola
atgacctgggagtatgcgcttattggattggttgttggtgttgtgatcggcgcggtggctatgcgctttggcaaccgcaaattgcgtcagcaacaagtgctgcaaaatgagctggagaagagcaaaacagatttggaagagtatcgtcaagagctggttgggcacttcgcacggagtgccgagttactggataacatggcccgtgattatcgtcagctttatcaacatatggcgaaaagctccaataacttattaccggacttaccattacaggataatccgttccgttaccgtctgacagaatccgaagcggataatgatcaggcacccgttaaactaccacctcgtgattactctgaaggcgcatctggtttattacgcccggaacaccagaatcgcgattaa

SEQ ID NO: 6958 - DNA, 399 bp, Escherichia coli C ATCC 8739; identical to SEQ ID NO: 6944

SEQ ID NO: 6959 - DNA, 399 bp, Escherichia coli SMS 3 5
atgacctgggaatatgcgctaattgggttagtcgtcggcatcattattggtgctgtggccatgcgttttggtaatcgtaaactacgccagcaacaggcgttgcagtacgaactggaaaagaataaagctgaactggacgagtatcgcgaagagctggttagccactttgcccgcagcgcggaattactggataccatggcgcacgactatcgccagctgtatcaacacatggcgaaaagctccagcagcctgctgccggaactgtctgctgaagcaaacccgttccgtaatcgtctggcagagtctgaagccagcaacgatcaggcaccggtgcaaatgcctcgcgactattctgaaggcgcatccggcctgctgcgtactggcgcgaagcgcgactaa

SEQ ID NO: 6960 - DNA, 399 bp, Shigella boydii CDC 3083 94
atgacctgggaatatgcgctaattgggttagtcgtcggcatcattattggtgctgtggccatgcgttttggtaatcgtaaactacgccagcaacaggcgttgcagtacgaactggaaaagaataaagctgaactggacgagtatcgcgaagagctggttagccactttgcccgcagcgcggaattactggataccatggcgcacgactatcgccagctgtatcagcacatggcgaaaagctccagcagcctgctgccggaactgtctgctgaagcaaacccgttccgtaatcgtctggcagagtctgaagccagcaacgatcaggcaccggtgcagatgcctcgcgactattctgaaggtgcatccggcctgctgcgtactggcgcgaagcgcgactaa

SEQ ID NO: 6961 - DNA, 399 bp, Salmonella enterica serovar Newport SL254
atgacctgggaatatgcgctaattggattagtcgtcggtatcatcattggtgccgtggccatgcgttttggtaatcgtaagttacgtcaacagcaggcattgcagtacgaactggaaaaaaacaaagctgagctggaagagtaccgtgaagagctggttagccactttgcccgcagcgcggaactgctggataccatggcgcatgattaccgccagctgtatcagcatatggcgaaaagctccagcagcctgctgccggaaatgtctgcggagtcgaatccgttccgtaaccgtctggcggagtctgaggcgagcaacgatcaggcgccagtacaaatgccacgtgattattctgaaggcgcgtctggcctgttacgtagcggcgcaaagcgcgattaa

SEQ ID NO: 6962 - DNA, 399 bp, Salmonella enterica serovar Heidelberg SL476
atgacctgggaatatgcgctaattggattagtcgtcggtatcatcattggtgccgtggccatgcgttttggtaatcgtaagttacgtcaacagcaggcattgcagtacgaactggaaaaaaacaaagctgagctggaagagtaccgtgaagagctggttagccactttgctcgcagcgcggaactgctggataccatggcgcatgattaccgccagctgtaccagcatatggcgaaaagctccagcagcctgctgccggaaatgtctgcggagtcgaatccgttccgtaaccgtctggcggagtctgaggcgagcaacgatcaggcgccagtacaaatgccacgtgattattctgaaggcgcgtctggcctgttacgtagcggcgcaaagcgcgattaa

SEQ ID NO: 6963 - DNA, 399 bp, Salmonella enterica serovar Schwarzengrund CVM19633; identical to SEQ ID NO: 6961

SEQ ID NO: 6964 - DNA, 399 bp, Salmonella enterica serovar Agona SL483
atgacctgggaatatgcgctaattggattagtcgtcggtatcatcattggtgccgtggccatgcgttttggtaatcgtaagttacgtcaacagcaggcattgcagtacgaactggaaaaaaacaaagctgagctggaagagtaccgtgaagagctggttagccactttgcccgcagcgcggaactgttggataccatggcgcatgattatcgccagctatatcagcatatggcgaaaagctccagcagcctgctgccggaaatgtctgcggagtcgaatccgttccgtaaccgtctggcggagtctgaggcgagcaacgatcaggcgccagtacaaatgccacgtgattattctgaaggcgcgtctggcctgttacgtagcggcgcaaagcgcgattaa

SEQ ID NO: 6965 - DNA, 399 bp, Salmonella enterica serovar Dublin CT 02021853
atgacctgggaatatgcgctaattggattagtcgtcggtatcatcattggtgccgtggccatgcgttttggcaatcgtaagttacgtcaacagcaggcattgcagtacgaactggaaaaaaacaaagctgagctggaagagtaccgtgaagagctggttagccactttgctcgcagcgcggaactgctggataccatggcgcatgattaccgccagctgtaccagcatatggcgaaaagctccagcagcctgctgccggaaatgtctgcggagtcgaatccgttccgtaaccgtctggcggagtctgaggcgagcaacgatcaggcgccagtacaaatgccacgtgattattctgaaggcgcgtctggcctgttacgtagcggcgcaaagcgcgattaa

SEQ ID NO: 6966 - DNA, 456 bp, Aliivibrio salmonicida LFI1238
atggcttggacatacgcattaattggtttagctattggtataagtattggctttatcatttctcgatttactataccgggtattaaacagcaaaaatcattaaaacaagatttagaaaaatcaaaatatgaattagagcaataccgacaagagctggttgatcactttgcaactagcgcgacaatgcttgaagcgttagcaaaagattttaataaaatgtatgaccacatggcgtcaacatctaaagagctaatgccaaatcttccagagcaagataacccatttaccgctcgtttagatgaaatgacactttctcctgaattaaataagaaagtggctcatataaaagaagaagtaagcaaacaacccaaagattatgcaaatggcgcaaccggtctacttaaagatgaaccattaatggatatcagcgcaaagaaagaagataaaattgcataa

SEQ ID NO: 6967 - DNA, 399 bp, Escherichia coli O157 H7 EC4115
atgacctgggaatatgcgctaattgggttagtcgtcggcatcattattggtgctgtggccatgcgttttggtaatcgtaaactacgccagcaacaggcgttgcagtacgaactggaaaagaataaagctgaactggacgagtatcgcgaagagctggttagccactttgcccgcagcgcggaattactggataccatggcgcacgactatcgccagctgtatcagcacatggcgaaaagctccagcagcctgctgccggaactgtctgctgaagcaaacccgttccgtaatcgtctggcagagtctgaagccagcaacgatcaggcaccggtgcagatgcctcgcgactattctgaaggcgcatccggcctgctgcgtactggcgcgaagcgcgactaa

SEQ ID NO: 6968 - DNA, 405 bp, Dickeya dadantii Ech703
atggcctgggagtacgcgctgattggattagttatcggtgtcattattggtgctgtcgccatgcgtttcggtaatcgtaagctgcgtcagcaacaggtattgcaaagcgaactggagaaaaacaaaacggaattggaacagtatcgtcaggagttagtgacccattttgctcacagtgcagagctgctcgacaacatggctcgcgattaccgccagctctaccagcatatggccaagagctccaataacctgttgcctgatacgccagtacacgaaaaccctttccgctatcggctgactgaagcagaatccgacaacgatcaggcgccggtgaatatgccgccgcgtgattactcggatggtgcgtccggcctgttgcaaggttcgcggcctgccagcaagtaa

SEQ ID NO: 6969 - DNA, 405 bp, Dickeya zeae Ech1591
atgacctgggagtctgcgctgattggatttgttatcggtgtcatcattggcgctgtcgcgatgcggttcggcaaccgtaaactgcgccagcagcaggtactgcaaaacgaactggagaaaaataaaaccgaactggaagaataccgtcaggaattggtcagccattttgctcacagcgcggaattgctcgacaatatggcgcgcgattaccgtcagctttaccaacatatggcgaaaagctccaataacctgctgcctgatgtgcccatgcaggataatcctttccgttaccgcctgaccgaagctgaatcagacaatgatcaggcgccggtggatatgccgcctcgcgattactccggcagcgcgtccggcctgctgcgcggcgcacgtccgacgggcaaataa

SEQ ID NO: 6970 - DNA, 405 bp, Pectobacterium carotovorum PC1
atgacttgggagtatgcgctgataggtttagtagtcggtattattattggtgctgtagccatgcgctttggtaaccgtaagctgcggcaacagcaggtcttgcagaatgagctggagaaaagcaaaaccgaactggaagactatcgtcaggaattggtgggtcacttcgcccgcagtgcggagctattggataacatggcggatgattatcgtcagctttatcagcacatggcgaaaagctccaataacctgttacctaacgttcccggccaggataatccgtttaaatatcgtctgaccgaatccgaggcggataacgatcaggctccggtgaacatgccaccgcgtgattattccgacggtgcatcaggcttgctgcggggcgaacgcccgattcgcaaataa

SEQ ID NO: 6971 - DNA, 603 bp, Yersinia pseudotuberculosis IP 31758
atggaattgagtttatttctgtcaatggttggttttctctgggtcgcggctattacccctggtccaaataatatgttgcttacctctgcgggtgctaacttcggctttatgcgctctatctggttgatgttaggtattatgttaggtatgcagagtatgctgctgctggtggcttttggcgtgggtagcctgattttgatctacccctccctccatctggcattgaaaattttggggagtttgtatctgctgtggctggcatggaaaattgccacttcagcctatgaaaaattagacaccaatgtggccccagccaaaccgctacgtttgtatcagggttggttattgcaatttcttaacccaaaagcctggctgatggggttaggctcggtagccagtttcagcatggcgggcgcagcctacaatcactccatcttgatgataagcctggggatgtttatggtgaatctggtggcagggattatttggctgggttttggcaccctgattggccgcctgctcggcagccgccgtgcttggtttacctttaatatctcaatgggcttgctgaccgccgcgtgtgttttactgatctggcattaa

SEQ ID NO: 6972 - DNA, 603 bp, Serratia proteamaculans 568
atggatgcgagtttatttctttcgatgttaggttttctgtgggttgccgcgatcacacctggccccaacaatatgttactgaccacttccggtgccaactttggctttatgcgttcactgttgctgatgattggcatcatgctcggcatgcaaagcattttgctgctggtggcgttcggcgttggcagcctgattctggtttatccggcgctgcatctggtgctgaaaattctcggtagcctgtatctgctgtggctggcatggaaagtggctaccgccgcttatgaaaagctggaaaccgacgtggcaccgcccaaaccgatacggctctaccagggttggctgctacagttccttaatcccaaggcctggctgatggcgctgggggcggtggccagcttcagcctggcgggtgctcaatacaacgcctcgattctggcgatctcactgggcatattcgtggtgaacatcattgccggcgtgatttggttgggatttggcacggtgattggccgactgctgcgcagcaaaaaggcctggatcatttttaacgtttctatggggttgctcaccgcggcctgtgtgttactcatctggcattaa

SEQ ID NO: 6973 - DNA, 603 bp, Yersinia pestis Angola
atggaattgagtttatttctgtcaatggttggttttctctgggtcgcggctattacccctggtccaaataatatgttgcttacctctacgggtgctaacttcggctttatgcgctctatctggttgatgttaggcattatgttaggtatgcagagtatgctgctgctggtggcttttggcgtgggtagcctgattttgatctacccctccctccatctggcattgaaaattttggggagtttgtatctgctgtggctggcatggaaaattgccacttcagcctatgaaaaattagacaccaatgtggccccagccaaaccgctacgtttgtatcagggttggttattgcaatttcttaacccaaaggcctggctgatggggttaggctcggtagccagtttcagcatggcgggcgcagcctacaatcactccatcttgatgataagcctggggatgtttatggtgaatctggtggcagggattatttggctgggttttggcaccctgattggccgcctgctcggcagccgccgtgcttggtttacctttaatatctcaatgggcctgctgaccgccgcgtgtgttttactgatctggcattaa

SEQ ID NO: 6974 - DNA, 603 bp, Yersinia pseudotuberculosis YPIII
atggaattgagtttatttctgtcaatggttggttttctctgggtcgcggctattacccctggtccaaataatatgttgcttacctctgcgggtgctaacttcggctttatgcgctctatctggttgatgttaggtattatgttaggtatgcagagtatgctgctgctggtggcttttggcgtgggtagcctgattttgatctacccctccctccatctggcattgaaaattttggggagtttgtatctgctgtggctggcatggaaaattgccacttcagcctatgaaaaattagacaccaatgtggccccagccaaaccgctacgtttgtatcagggttggttattgcaatttcttaacccaaaagcctggctgatggggttaggctcggtagccagtttcagcatggcgggcgcagcctacaatcactccatcttgatgataagcctggggatgtttatggtgaatctggtggcagggattatttggctgggttttggcaccctgattggccgcctgctcggcagccgccgtgcttggtttacctttaatatctcaatgggcctgctgaccgccgcgtgtgttttactgatctggcattaa

SEQ ID NO: 6975 - DNA, 606 bp, Dickeya dadantii Ech703
atggatcacgtcagcctgtttctttctatgttgggtttcttgtgggtcgcagcgattactcccggccccaataatatgctactcaccgcatccgccgccaattttggttttttgcgctctctgccgttaatgctggggatcatgatcggcatgcagagcattctgctgttggtatcgctggggctgggcagcttgattctgctctatccgcctttgcatctggcgttgaaagtgttgggtagcgcttatctgttgtggctgtcgtggaaaatagcctccgcagcctacgaacggctggatctggacaccgcgccgtcggcgccgatgccgttgtatcagggcgggttgttgcagtttctcaatcccaaggcgtggctgatgtcgctgggcgcggttgccggtttcagtctggcgggcgatggttataccgggtcggtgttgtcgatcagcgtggcgatggcgctggtgaacgcggtcgcgggcgccgtctggctggcgttcggcgccgccatcggccgtctgctgcgtagcccggtcgcctggaagcgctttaatatttcgatggggatcctgacggccgcctgcgtgttgatgatctggcattaa

SEQ ID NO: 6976 - DNA, 606 bp, Dickeya zeae Ech1591
atggagcacgtcagcctgtttctttcaatgctcggtttcttgtgggtcaccgccattacgccgggccccaataatatgctactaaccgcctccgccgccaactttggcgtattacgctccatgtcgttgatgttgggcatcatgatcgggatgcagatcatgctgctgctggtggcgttggggctgggcagcctgatcctgctttatccgtcgctgcatctggcgttgaaggtgttgggcagcgtgtatctgctgtggctgtcgtggaaaattgctacggcggcttatgaaaaactcgacacggataccgcgccgccgaagccgattccgctgtatcagggcggtttgctgcaatttctcaatcccaaagcctggttgatgtcgctgggcgccgtcgcggggttcagcctggctggtgatggttatgtcgggtcggtggtggccatcagcgttgcgatggtgtgcgttaatttcgtggccgggattatctggctggggttcggcgcgatgatcggccgtttgttgcaaagcccgcgcgcctggaagatattcaatctcgtcatggggttactgacggcgacctgcgtgctgatgatctggcattaa

SEQ ID NO: 6977 - DNA, 603 bp, Pectobacterium carotovorum PC1
atggaactgagtttatttctgtcgatgttagggtttttgtgggtggcggccatcacgccggggccgaataatatgctgttgaccacctcgggcgcgaattttggttttatgcgttcactgtggctgatgatcggcatcatgctgggcatgcagagtattttactgctggtggcattcggcgtcggtggcttgattctgatttatccttcgctgcactttatcctgaaagtcctcggtagtgcctatctgctttggctggcgtggaaaatcgccacggcggcttacgaacggctggaaacgtccgttgcgccgcccaagccgatccggctttatcaggggtggttactgcaattcctgaacccgaaagcgtggctcatggcgttgggcgcggtggccagttttagtctggcgggtgaagagtataaccattccgtgatcgcgataagcatcgggattgtgctggtcaatctggtgtccggtgttatctggctcggatttggcacgatcattgggcgactgctgcgcagtaagaaagcatggattatcttcaatgtgtcaatggggctgctgaccgccgcctgcgtgctattgatttggcattaa

SEQ ID NO: 6978 - DNA, 357 bp, Bacillus anthracis Ames 0581
atgatacaaacgaaagataaaataaaagttatgcgtgcagaagatcttcctattcaaatcggtaaagaggtccaaatgaaaggtatgtctatcgccctattccgcctttcaaatggtgatattcgagctgtagaaaatcgttgtcctcataaaaacggaccattagccgaaggaattgtatctggtgaattcgtcttttgtccgctacatgattggaagatttcattacttacaggtgaagttcaaaaacctgatgacggttgtattcaaacgtacgaagtagaagtcattaatggtgacatttatatatatatatgtaatttacaaaaggaagcctcccccctggcttccttttaa

SEQ ID NO: 6979 - DNA, 357 bp, Bacillus anthracis str Sterne; identical to SEQ ID NO: 6978

SEQ ID NO: 6980 - DNA, 318 bp, Bacillus thuringiensis konkukian
atgatacaaacgaaagataaaataaaagttatgcgtgcagaagatcttcctattcaaatcggtaaagaggtccaaatgaaaggtatgtctatcgccctattccgcctttcaaatggcgatattcgagctgtagaaaatcgttgtcctcataaaaacggaccattagccgaaggaattgtatctggtgaattcgtcttttgtccgctacatgattggaagatttcattacttacaggtgaagttcaaaaacctgatgacggttgtattcaaacgtacgaagtagaagtcattgatggtgacatttatatatatatgtaa

SEQ ID NO: 6981 - DNA, 318 bp, Bacillus cereus ZK
atgatacaaacgaaagataaaataaaagttatgcgtgcagaagatcttcctattcaaatcggtaaagaggtccaaatgaaaggtatgtctatcgccctattccgcctttcaaatggcgatattcgagctgtagaaaatcgttgtcctcataaaaacggaccgttagcagaaggaattgtatctggtgaattcgtcttttgtccactgcatgattggaagatttcattactaacaggtgaagttcaaaaacctgatgacggttgtattcaaacgtacgaagtagaagtcattgatggtgacatttatatatatatgtaa

SEQ ID NO: 6982 - DNA, 312 bp, Dechloromonas aromatica RCB
atgagtaactggaaactgatttgcctgctggaagacatcccgcaattaggctcgcgcatcatcaagccggccactggtggagacattgccatcttccgtacctccgatgaccaggtgttcgccatgcacgataaatgcccgcacaagggcggtcctctgtcgcagggcatcgttcatggcaagcgggtgacttgcccgctgcacggctggaacatcgggctggaagacggcaaggcggtggcaccggatgtcggtggttgcaccaagttcgaggtcaaggtcgagggcgggcaggtctacctgtccgtctga

SEQ ID NO: 6983 - DNA, 390 bp, Acidovorax sp. JS42
atgaccacctggaccccgatctgctccctggacgacatccccgtgctcggcgcgcgccgcgtggcccgcccgcacggcatggacgtggccgtcttccgcaacgacgccggcggtgtgttcgccctgctcgaccgctgcccccacaagggcggccccttgagccagggcatcgtcttcggcaacagcgtggcctgcccgctgcacaactggaccatcggcctgtgcgacggccaggccgccgcccccgacgaaggctgcacgccgcgctttcaggtcaaggtggaagccggctccgtctacctggacgcccaggaactggcccaccacgccctggacctgcaacgccccgtggccggccccgcgctgcgctgcaaggcaaacccaccatga

SEQ ID NO: 6984 - DNA, 423 bp, Verminephrobacter eiseniae EF01-2
atgaccgagcacattcccgattggcaagccatctgccgcatcgacgacatcccggtgctgggcgcgcgccgcgtggcccgcccccgggggctggaggtggcgctgttccgcaatgccgacggcggcatttttgcgctgctcgaccgttgcccccatcggggcggccccctgagccagggcatcgtgtttggcacccgggtggcctgccccctgcacaactggaccatcgacctgtgcgacggccaggcccatgcgcccgatcagggatgcacaccccggtttgccgtcaaggtggacaacggcacggtctacctcgaccgccatgaactggcgacgctggccaccgatcagacccggccgggcgccgggccggcaaggccggcacagtcggcacagtcggcccaaagggcgagcgcagcctga

SEQ ID NO: 6985 - DNA, 501 bp, Geobacter sulfurreducens
atgcacatcgttatgaccatccacggctttgcccttgactccatcgcccagatgccggtggtgctcctgaaggatgaacgcggcgaagtaacgctgcccatctggatcaacggcaccgacaccctctatatcgtggcggagctgatcaggcgggacgcctcttcctcgggggagcgcaaggacctgctcacggcattgctcggccatctgggggccgaggtgctcgatatttccattgacggcggcaaggacggcaagttcatctgctccgtccggctcatggtgggggaagaggagttgcgcctgccggtccgcatttcggaagccatcgtcctcgccctcaaaaatgccctgccggtcatggttccccgccatctggtggaggaggcgaccgccccggccggcaccatgggcgaccacttcacggaggccgacgagcgtcgtttcgtcgattttctcgaaggcctcgatcccgccgatctcggcaagtatcccatgtga

SEQ ID NO: 6986 - DNA, 501 bp, Geobacter metallireducens GS-15
atgtacctgaagatgaacatccacggctttgccctcgactccatcgcccagaggccggtcgtcctcctcaaggatgccgatgaggcgaataccatccccatctggatcaacagcagcgacaccctgtacatcgtggccgaactcgtccgccatgacgccgcggccaagagcgaccgcaaggatctcctctcggcgctgctcggtcatttggacgcagaagtggcggagattgtcatcgaggacatgaaggacggcctcttcgacgcttcagtgggggttttgctggacggcgagacggtgctgctcccggtgcggatccccgaggccctggtgttggccctcaagcactccctgccggtcatggtggcggaccacctactcaacaagattgcaaagagcaacggtgacaccgacgaacgcttcaccgacgccgatgcgcgccgctttgtggattttctcgaaaacctcgatcccgccgatctcggcaaatatcccatgtga

SEQ ID NO: 6987 - DNA, 552 bp, Desulfovibrio desulfuricans G20
atgctgattgaaatgaaagttctgggcctgtcgctggacgagaccagcaaagcccccatactcatcctgcagcagaaggacggcaaggatgtcctgcccatctgggtgggcgccatggaggccatggccatatccatagccctcaacgaggtggaaacgccccgtccgctcacacacgatctcatgctgtccacgctgtcttcgctgggtgcccgccttgtttccgtcaatgtgaccggactgcgggaaggaacctactacgcggaactggagatcacctgcggcagcaccctttccagagtggactcgcgcccgtccgatgcggtggcgctggctctgcgcgccggagcccccatccgcgtaagtgatgaagtgctgcggctggccgaagagtcgcgccttaaaccgtctcagggcgatcccgccctgctgcgcagacccgctgacgccgctgcttcttttctccgccccgaagaagcggaaaaacagtccgacgaagaactggaagagctgctgcgcaaactggaccccgtcacaagatataaaatgtga

SEQ ID NO: 6988 - DNA, 486 bp, Candidatus Koribacter versatilis Ellin345
atggaagtcgaaatgaaaatccgtggtctgatgatggatccggtgaccaacatgcccatcgtgatcctgaaagatgtcggcagcgacaccgtcctgcccatatgggtcggcgtgtatgaagcaaacgccatcgcgcttgagattgagaaggtcaccaccccgcgaccgatgacccacgacctgctgaagaatgttctgctcggcatggaagcacaggttgagaaagtcgtggttacggagctccgcgaagacaccttctacgccgtgatttgggttacccgaaacggaagcccggtgagtatcgattcgcgcccgtcggatgccctggccttggcattgcgcgtggattgcccgatttatgtggaagacgaggttctgaagaccagcaagcaggcggctcaaatcagcgaccgcgtgaccgcagacgacctgcgcaagtggctcgaaggcttgggcgacgacgatctcggccgctacaagatgtag

SEQ ID NO: 6989 - DNA, 483 bp, Moorella thermoacetica ATCC 39073
atgctcataccggtaaaggtgaaacaaatagtcctggatcaaaccctaaatccggtagtgttactgggtgaaccggaggggaatcaggtattgcctatctgggtaggtcccttcgaagcccaggccattgccctggcaatgcagggtatcttaacaccgcgtcccctgacccatgacctgttacgttccctttgtgaaaacctgggggtagaagtgaataaagtcctggtccaggatatcagggatggtacctactatgccgaactttacctccgccagggagatagagaggtggtcgtagacgcccggcccagcgacgccatagccctggccctcaggaccaacgcccccctttatatcaccgagaaggtggccgcttacaccctcaatgtcgaagacctggtcagcgaggaccaggccgaggagttgcaacaaatgctgacggatatcaaacccgaagtagataaaaaacacctgcattag

SEQ ID NO: 6990 - DNA, 498 bp, Syntrophobacter fumaroxidans MPOB
atgttcaaggaaatgaaggtcacggggctggtgatggatccgcagaccaacacgcccatcctgatattgagggacgtcaaggacgataccaccctccccatctggatcggcctcctcgaagcgacctccatcgccaccgagctggagaagatccagttcccccgtcccatgacgcacgacctgatccgcaacttcttcaaccatctcgatgtaaaagtcgaacgcatcgaagtgtgcgatctccgcaacaacacttactacgccctcatctacatccgcgatcgagaccgtgtcagctccatcgacgcgcggcccagcgacgccatcgccatcgcgttgcgcacgcaggctcccatttacgtgaaggaggaggtcatctccaagttccagaaatccgatgaatcggcaaaaccggttttcgacaaggaaaaccgggaaaaatggtccgagcttctggaagggctcaatccggaagatttcagcaagtacaaaatgtaa

SEQ ID NO: 6991 - DNA, 546 bp, Desulfovibrio vulgaris DP4
atggtagaaatgaaagtcgtcggtctttcgctcgacgagtcgaccaaggctcccatcctcgtgctgcggcgcgaggagtcggacgaactgcttcccatctggataggtgcgatggaggccatggccatttcgctggcgctcaacaacgtcgacgtgccgcgccccctcacgcacgacctcctgctgcacacactgcacgcgctgcgggccgaacttgtggcggtcgaccttgtggatttgcgcgagggaacctacttcgccgaactcgtgctcatcgcggggggccgtcaggcgcgtgtggactgccgcccgtcggacggcatcgccctcgccctgcgcgccggggtgcccatcctcgttcgcgaagatgtgctccgccgcgccgccgaggaccgtatgcgccccatgcaggatgatagcgccgtgctgcgggcccccggcgacacgacactgggcatgacacgcgaacagctcgacgaacccgacgagaaggaactgtcagacctgttgcagtcgctcgacccagagaccaagtacaggatgtag

SEQ ID NO: 6992 - DNA, 501 bp, Geobacter uraniumreducens Rf4
atgtatcacgagatgaaaatattcggttttgccctggatgccatcgcgcaaatgccggtaataatcctgaaggatgatgcgggtgagaattcggtgccgatctggatcagcactcaagaatccgtctcgcttgctgtcgagcttatcagtcgggacatatctttccagagcgggcggggcgacttgctgacggttctcatgcagcagatggggatgaggattgaaaagattgccatcgaaagtctgcgggacggcgtgtttgccgcatcggtcaagttcggcggcaaaagcaaaaaacatctggtcgatgtgcgtgtcagcgaggcgatgatggctgccctcaagtataaactgccggtaatggtgcatgaagaggttgtgaagcaggcacccatgcttgatttgaatgaagggcatttttcccgggaaaccgatgcacgccgttttgtggattttctggaaaatctcgatcctgctgcgatggggaagtatccgatgtag

SEQ ID NO: 6993 - DNA, 504 bp, Candidatus Desulfococcus oleovorans Hxd3
atgctgcataaggttgatattctgggcctggccctggaccaggactccaaaaccccgattctggtactcaagaccgtggacacccaggagaccattcctatctggatcggcctgctggaggccacggccattgcatcggcccttcaggaggtccatttcgaacggcccatgacccacgacctgttcaagaattttatcgccatgatgcatgtggatgtggagcgcattgaggtgtgcgatttgaaggagaacaccttttacgcgcgtatctattttgcctccggcgacaacgagttctccattgacgcccggcccagcgacgccgttgccatggcggtgcggtttagcgctccggtgtttgtggatgaaaaggtgatcgcggccctcaaacccgacggcggggcccgaacttacgaggtcaaggacaagagcgaagagggaaagaagtgggccgagtatctggccagtctttctcccgatgattttggaaagtataaagtgtga

SEQ ID NO: 6994 - DNA, 483 bp, Sulfurihydrogenibium YO3AOP1
atggttgagatggaagtccaaggtattacattagacccaataacaaacatgcctgtgttgttattaaaaggcaaagaaaatgatgaaattctaacgatttggatcggagtatttgaagcaaactcaattgctatgtatttagaatcaatgacctatccaagaccgctaacctatgacttatttacaaacatcctaaactcgctctcaacatccgttgaaaacataataatccatactttaaaagataatacttattatgcttcaatcatcttaagagacaaggaaggtagaactgttgaaatagatgcacgtccaagtgatgctataaacattgctctaaggtctagatgtccaatattggtttcagaagaagttttagctgaagctaataatggcaaaaaagaaaaaattgatgaagaagacctaaaagaatggatagaatcactaaagccagaggattttgagaaaaatatagaattctaa

SEQ ID NO: 6995 - DNA, 534 bp, Geobacter bemidjiensis Bem
atgactgaaacgaaaatgggagaagccaatatgtatctggagatgaaggtgttcggcttcgcgctagatgccatcgcgcagatgccggtgatcatattgaaggataccgaggaaaagcacgcggtgccggtctggatcaacgcacaggattcggtcgccttcgctgcccagttcgtggggcgcgaagcggctgccaggacccgccgcaaggacgtctttaccgcgctcgtcgaacagatggagatgacgctgtcccgcatcgtcatcgaaagccttaaagacggcgccttcacctcctccgtgcggctgttgccccgggaaggtgaggagatccggctggaagtgcacgtgaccgaggcgatgctcctctctctcaggtaccagcagcccgtgctggtggaccccgacgtgctggcccaggtctccaccctcgacctcaaggaggacggcctggccggcgagaacaacgcccgtcgtttcgtcgacttcctggaccacatggatcccgcttccatggggaagtaccccatgtag

SEQ ID NO: 6996 - DNA, 729 bp, Desulfovibrio vulgaris  Miyazaki F
atgatagaaatgaaggtcgtggggctgtcgctggacgacgccaccaaggcgccgatcctcgtcctgcgccgcgaggccggggaggaactgctgcccatctggataggggccatggaagccatggccatctccatagcgctcaacagcgtggacgtgccgcgcccgctcacacacgacctgctgctgaacaccctgcgttcgctgggggcgcaactggtggccgtggacgtggtggacctgcgcgacggcacctacttcgccgaactggacatcctgctgaacggttcgcgcacccgcgtggactgtcgcccctccgacgccattgccctggccctgcgggccgacgtgcccatcttcgtcagcgaggacgtgctgcgccgcgccgccgaagaccgcctgcgccccaacatggacgaaaacgccgcccgccgccccaccgacgccgcgtcggccatggcccgagaggaaaccgcccggcgcgacgtgcgccgcagggcgggccagcccccgtgggccgacggcgaagccggcagtcccatcaacgtggagcagatttcccgcgtccgcgaggccatgggagatcaacgcgccgcgaagcacaaggccgaccaggccactgatccgtcggcagaccaggcaacggatcgcccgcgcgatcagcacgatctggaagagcaactggcggaactgctgcgctcgctggacccggaaaccaagtaccgcatgtag

SEQ ID NO: 6997 - DNA, 615 bp, Desulfovibrio desulfuricans ATCC 27774
atggtagagatgcgtgttttcggcctgaccattgacccgcagaccaaaacccccatagtgatactgcgcgaaatggaaggagagaccgtactgcccgtctgggtgggggcaatggaagccatggccgtttcgcttgtactcaataaagaaaacctgccccggccccttacgcacgatcttttgcttatggcactgagggcgctcaaggccgggcttgtcaaagtggaaatcaccgatctcaaggatggggtattttttgccctgctggtgctgcaaggccccggcgggcgcgtacgtgtggactgccgcccttcggatgccatagctctggccatgcgggccgaagcaccgatcatggtcaacgaggacgtgctgcgccgtgccgccgaggctcaggaaaaagccgaacagcgcctgcatgaggaagtcctttcccctgtgcctgacgccgctaccgacatggtgcgcaaggccggggcgcgcaaagaggcagacatgctgcacagccggctgctgcacggcacggttctttctgatgatattgatccggaagaagaacgccgctttcgtgaaatgctgcgttcgcttgaacccatctcacggcgaaaaatgtag

SEQ ID NO: 6998 - DNA, 495 bp, Desulfomicrobium baculatum DSM 4028
gtggtagacatgatggttttcggattggcactggacgaggattcgcagatgcccatccttattttaaaggacacatcggaagatatcatttttcccatctggatcggcgccatggaggccatgtccatttccatggccctgaacaaggtcgccgtacccagacccatgactcacgacttgattttgaccatactggagaagatggaaacccggctggtcgcggtggagatcatctccatccacgaaggcacctattatgccgaacttgtgttgcaaggcgagaccggcgagcgccgcgtcgattgccgtccttcggattccatcgccctggccctcagagcccaggtgcccatccgtgtttcggaggaagtcatcgctttgaacaagacgttgcagaaaggcgtttttcaggaggttgtcacgggcgaggacagcgacaagtggacggacatcctctccaagtacagcctggacgatctcaagtacaagatgtga

SEQ ID NO: 6999 - DNA, 504 bp, Geobacter M21
atgtatctcgagatgaaggtgttcggcttcgcgcttgatgccatcgcgcagatgccggtgatcatactgaaggatgccgaggaaaagcacgcggtgccggtctggatcaacgcgcaggattcggtcgccttcgccgcccagttcgtcgggcgcgaagccgctgccaggacccgccgcaaggacgtcttcaccgccctcgtggaacagatggagatgacgctgtcccgcatcgttctcgaaagccttaaagacggcgtcttcacctcgtccgtgcggctcctgcccagagagggggaggagctccggctggaggtgcacgtgaccgaggccatgctcctctcgctcaggtatcagcagcccgtgctggtggaccccgaagtgctggcgcaggtctccaccctcgatctgaacgaggacggcctggcccaggagaacaacgcccgccgtttcgtcgacttcctggaccacatggatcccgcctccatggggaagtaccccatgtag

SEQ ID NO: 7000 - DNA, 495 bp, Desulfohalobium retbaense DSM 5692
atggtagaagtcgaagtatttggtctggccctggacgaatcctcgcagattccgctgctcattctcaaggaccgggaggagcagcatgttttgccgatctggatcggggtcatggaggcggtggccatttccatgaccttgaacgaggtggacatgccccggccgatgacgcatgatctttttttgaacaccatcgaccagatgggcggggaattgcagcgggtggaggtcatcgacctgcgcgaggggaccttttatgccgaacttgtggtcgcgtacggcgaaaccgtcaaacgggtcgacagccggccatcggacgcggtagcgctggccttgcgggcgacgtgcccgatttttgtgcatgaaaatgtcttcgaggccgtggaaaaacgcaaagggaaatcttacgaggtcggcgtccaggaggaagaggccgaaaaatggacggacatgctcgagagtctggacctcgatgatctgaaatacaaaatgtaa

SEQ ID NO: 7001 - DNA, 273 bp, Brucella suis 1330
atggcacccgatacgatcctcaggcaagccttggaacggctggaaaaggcactcaatacgcttgaagaagcggtcgatctgcggctggacaaggaaggcgatttcgccgaggccgaggaggaggtgcagcgtatgaatgcggatcgcagccgtctcgcacaggaactcgatcagtcggaagcgcgcgccgagcggctggaagctgcaaaccgtgaagtttcgcgccgtctcgtgaccgccatggagacaatccgcgccgttctggatcgatag

SEQ ID NO: 7002 - DNA, 336 bp, Nitrobacter winogradskyi Nb-255
atgaacgaccgaccggccaatcgttccgccagtgctgaaccgcccaatgggggcgggggaaccgatatcgacgccgccacccggcggctgacggccgcgctcgatgcgctggaacgggcggtggagcggcggcgcgacgcggaccgcgacgaggacgaactggcgagccgcattcaggctctcggcgcggatcgctcacgccttgcggatgaactcgacggatcgctggtgcgcacgcgcaagctggagcggaccaatcgtgagatcgcggaaaagttggacaccgcgatcggcgccatcaagtccgtgctcgaggcggcgggagagaagccatga

SEQ ID NO: 7003 - DNA, 336 bp, Rhodopseudomonas palustris HaA2
atgaccgatcgtcccgtccccggttccatcagcgccgatcaggctccgaccgagatcgtcgcggcgacgcgtcgtattgccgctgcgctcgaggcactggagagcgcggtggagcgtcgtgccgaggccgatcgcgacgaggacgagctggcttcgcggattcaggcgctcggcgccgaccgctcgcggctcgccgacgagctcgacggctcgctggtgcgcacccgccggctggagcgcaccaatcgcgagatcgcgcagcggctcgacgccgcaatcggcaccattcgcgccgtgctcgacaccgagccggccgacgaggaggagccgtcatga

SEQ ID NO: 7004 - DNA, 315 bp, Rhodopseudomonas palustris BisB18
atgactgatcgcccacccggttccctggctcagacgctgtcgtcggacatcgcggcggcgacgcgacggctgcaggcggcgctcgaggcgctggaaagcgccgccgagcgacgcagcgaggccgatcgcgacgaggacgaactggcgtcgcggatccacgcgctggggatcgaccgctcgcggctggccgacgaactcgacggctcgctggtccgctcgcgcaagctggaacgcaccaaccgcgagatcgccgaaaaactcgatgccgcgatcggcaccatccgttcggtgctcgatgccgaggatcccgcatga

SEQ ID NO: 7005 - DNA, 333 bp, Rhodopseudomonas palustris BisB5
atgaccgatcgtcccgtctccggttccatcagcgccgatcaggctccgaccgagatcgtcgcggcgacgcgtcggctggccgctgcgctcgaggcgctggagagcgcggtggagcgccgcgccgaggccgatcgcgacgaggacgagctggcctctcggatccaggcgctcggcgccgatcgctcacggctcgccgacgaactcgacggttcgctggtacgcacccgcaagctcgagcgcgccaatcgcgagatcgcgcaacggctcgacgccgcgatcgggaccatccgcgccgtgctcgagaccgagcaggccgacgaggaaccgtcatga

SEQ ID NO: 7006 - DNA, 333 bp, Nitrobacter hamburgensis X14
atgaacgaccgacccgccaaccgttccgccaattccgagccggccaatagtggcgcggtcgagatcgacgcggcgacccggcggctgacggccgcgctcgatgcgctggaacgagcggtggaacggcggcgcgaggcggaccgcgacgaagacgagctggcgagccgcattcaggcgctgggcgcggaccgttcgcggcttgcggacgaactcgacggcgcgctggtgcgtacgcgcaagctcgaacgcgccaatcgcgaaatcgcccaaaaactcgatgcggcgatcgaaaccatcaagtccttgctcgacgcggcgggggagaagccatga

SEQ ID NO: 7007 - DNA, 273 bp, Mesorhizobium BNC1
atgagtggggaagccacgctgagagaagttctcatacgcctcggaaaggccatcgacagcctggaggctgcgtctgacgccaggcttgagcgagaacgcgatttctctgaagccgaagccgaagtgcagcggatgggcgccgatcgtgcgcgcctggcgcaggagatcgacaaatccgaggcgcgggcggaacggctttcggaagtcaatcgcgaagtatcgcgcaggctggtagcggcgatggaaacgatccgcgccgttctggatcggtag

SEQ ID NO: 7008 - DNA, 294 bp, Maricaulis maris MCS10
atgaacgtgcgcgccgacatgcccgaagatgcccttgaggccgtggtcgcccgcctcgatacagcgatgagccgggtcgagggtgtggcgcggtccatgcgcgaacgggtccgtcgggccgagaccgccgcaatcgaggcaagggacgcggatgtcgatcgcgccaatctggcagacgcgttggaccaggcgcgcggccgggaggccgtgttgcaggatgcggcgcaggcggcgtccgacgcgctggataccgcgatcactgatttgcgcgacttcctgaccgaggaagggtga

SEQ ID NO: 7009 - DNA, 318 bp, Bartonella bacilliformis KC583
atgatttgtttttgtgaaaaaatgataaagggtgaaatcgttatgaatcaagagactactgctttgccagaagtgctcaagaaattagataatgcactgaagactctagaaaccacaattattaatcacaatattctcatggataaacataatgagtgggaagaggaaattcagtacatgaacgcagatcgcaaccgtcttgctcaagaacttgataactctgaagcgcgtgcagaacggttaaaagaagccaacaaggaagtttccagacggcttatcacagccatggaagctattcgcactctcctcgatcgataa

SEQ ID NO: 7010 - DNA, 351 bp, Bradyrhizobium BTAi1
atgaacgatcaccctgccaatcttgccggtcaggtggaacccggcgccgccgatcttgaggcggcgacgcggcgcctgatgaccgcgctcgacgcgctggagagcgcagtcgagcggcggcgggaggctgatcgggacgaggacgagctggcgacgcggatccaggcgctcggcgccgatcgctcccgcctcgcggatgaactcgacggctcgctgatgaaaacgcgccggctcgagcgcaccaatcgcgagatcgccgagcgcctcgatagcgcgatcggcaccattcgcgcggtgctcaatggcggcgacgcgcaggacaaggcgcatcatgatgaggatgacgaatga

SEQ ID NO: 7011 - DNA, 420 bp, Brucella ovis
atgaacgttctcattaacccgtcatttgttgcttatcgggcgggcgattattactatccttgcaaagatgcccgtcccgcaggtgcgattcgatgcccggagttggcctgcgaattggatcaagaactggcgttggaaaggatatggatggcacccgatacgatcctcaggcaagccttggaacggctggaaaaggcactcaatacgcttgaagaagcggtcgatctgcggctggacaaggaaggcgatttcgccgaggccgaggaggaggtgcagcgtatgaatgcggatcgcagccgtctcgcacaggaactcgatcagtcggaagcgcgcgccgagcggctggaagctgcaaaccgtgaagtttcgcgccgtctcgtgaccgccatggagacaatccgcgccgttctggatcgatag

SEQ ID NO: 7012 - DNA, 270 bp, Sinorhizobium medicae WSM419
atgccggcaaagacggtcaaggcggcgatcgacgagttgcgcaacgcggttcagtcacttgaaatcgcgatcgacggccgctttgacaaggaaagggatctgagtgagttcgaaggcgaggtcaggcgggtcaacgaggaccggtcacggctggcgcaagagcttgaccagtcccagtttcgcgcaaaccggttggaagaggtcaatcgcgaggtatcccggcgtctggtgacggcgatggagaccattcgcgcggtgctggatcgctga

SEQ ID NO: 7013 - DNA, 273 bp, Ochrobactrum anthropi ATCC 49188
atggcacccgaaacgaccctcaggcaagtcttggaacggctggaaaaggcactcaatacgcttgaacaagcggtcgatctgcggctggacaaagaaggcgacttcgccgaggccgaggaggaggtgcagcgtatgaatgcggatcgcagccgtctcgcccaggaactcgatcagtcggaagcgcgcgccgagcggctggaagctgctaatcgcgaggtttcacgccgccttgtgactgcgatggagacaatccgcgccgttctggaccgatag

SEQ ID NO: 7014 - DNA, 267 bp, Parvibaculum lavamentivorans DS-1
atgagcaaactcgacgcttcgatggaccgcttctcaagcgcgctggaccggttggaggccaccatcaatcggcaggtgctgcgggcacaggcggccaagcggcttcaggaggaggtcgaaaccctgaaggaagacagggctgagctggcggaggagctcgatcagctgaagtcggaagcacggcggctcaacgagctcaacgaaagagcgtccgagacgctggccgatgctatcgaggggattcgcgaggtcctcgccgaaagctga

SEQ ID NO: 7015 - DNA, 321 bp, Methylobacterium extorquens PA1
atggcgcgagcggatacgaaggcagcgcagggcagaaggcaggacggcgtcgggctggaagaggcgctgcaccggctcgatacggcgttggcgctgctcgagacggcggtggcccgcaagctcgaagccgagcgcagccgcggcgaccgggagacggagttcgccctgctggaggaggaccgggtgcggctcgctgccgaactcgatgcggcgggcgcgcggctcgcccggatgaattccaccaccggcgaggtcaaccgccgcctcgatcgcgccatcgagacggtggaagacgtgctgtccggcccgtccgggcgctga

SEQ ID NO: 7016 - DNA, 285 bp, Methylobacterium radiotolerans JCM 2831
atggccgacgagaccgagaccatttccatcgacgacgcgctcagccggctcgaagcggcgatcacccgcctcgacgccgtcgtccagcaccgcctcgagaccgacgcgcagcccgacgaccgggacgcggagctcgccctgatggacgaggatcgagcccggctggccgccgccctcgacgcggcgagcgcccgcctcgccgcggtctcggcgacgaccggggaggtcgggcaccggctcgaccgggccatcgagaccgttcaggatgtgctcggacgcgcctga

SEQ ID NO: 7017 - DNA, 450 bp, Beijerinckia indica ATCC 9039
atgcacctatcggaagaacttgccgaaagtttgaaacggatcgaggccatcctggaccgcctggaggcggcaagcgagcggcggttgcggcaggatcaagcgcgcggcgatatagccgccgaattacgcctgatgcaagacgatcgctcccgcctggcggtcgagctcgatcaagcacttgcacgcaacgaagcgctcgccaatgcccaggcggaggtctcgcaacgcttgcaaagcgtcgggacttcattgcagacgattctcgcccggacggaagccacggtcatttcgtccgatgagatgtcctccgtcgaaacgccgacccttgaggctttgcaggttgagactttgcaggttgcggcttcgcatggcgaggctgcgcatgcagacacctcgccatccgagcgcctcgtggcgcccggcggcgccacgccgcccgagcgagtgtaa

SEQ ID NO: 7018 - DNA, 321 bp, Methylobacterium populi BJ001
atggcgcgagcagattcgaaggcggggcagacgagggcgcaggaggctggcagcctggaagaggcgctgcaccggctcgacacggcgctggcgctgctcgagacggcggtggcgcgcaagctcgaggccgagcgcagccgcggcgaccgcgagacggaattcgccctgctcgaggaggaccgtgtgcggctcgccgccgaactcgatgcggccggcgcgcggctcgcccggatgacgagcaccaccggcgaggtgaaccgccgcctcgatcgcgccatcgagaccgtggaagacgtcctgtccggccccgccgggcgctga

SEQ ID NO: 7019 - DNA, 345 bp, Rhodopseudomonas palustris TIE 1
atgacggatcgtcctgcccacggttccatcgctaccgatcaggcaccggccgagatcgttgcggcggctcgccgccttgcggcggcgctcgaagcgctggaaagcgcggtggaacggcgtgccgaggccgaccgcgacgaggacgagctggcatcgcgaatccaggcgctcggcgccgatcggtcgcgcctcgccgacgaactcgacggtgcgttggtacgcagccgcaagctcgagcgggtcaatcgcgagatcgcgcagcggctcgactccgcgatcgacaccatccgtcacgtgctcgacacggaagcgggcgatccacagccggccgaggaggagtcatga

SEQ ID NO: 7020 - DNA, 282 bp, Methylobacterium sp. 4-46
atgagtgcggccgtggacgacgcgctgcgccggctcgatgccgccgtcgccctgctcgacgccgccgtgacccgtcggctcgacgccgagcgcagccggggcgacctggaggccgaactcgccctgatgcaggaggaccgggcccgcctcgccgccgagctcgacgcggccctgggccagctcgccgaggcggtggcggtgaccgacgacgtcgagcatcgcctcgggcgggcgatcggcaccgtcgagaccgtgctgacgcgcaaccgcgcggaagggtga

SEQ ID NO: 7021 - DNA, 273 bp, Rhizobium leguminosarum bv  trifolii WSM2304
atgcccacaggcaaaaccatggaagcagcgctcaacgaattgagacaggcgatttcaagcctcgaaaacgccgtcgacatgcgcgtcgagcgcgagcgcgagcagggcgagatcgagggtgaagtgcggcgcgtgcacgccgatcgctcccggttggcgcaggagctcgatcaggccgaattccgcgccaaccggcttgaggaagtcaaccgcgaggtgtcgcggcggctggtcacggccatggaaacgatccgcgcggttttggatcgctag

SEQ ID NO: 7022 - DNA, 288 bp, Methylocella silvestris BL2
atggacatcccccaacgcctggacgacgccttgaagcgcctttccgcctcgctcgagaagcttgaggcggcgagcgaccggcgcgccaaaagcgacgccatgcgcgccaatcttgaagaagagcttgccgtgctgcaggatgaccgctcgcggctggccgtcgagctcgacggggccatcgcccgcgcggtcacgctcgagggcgcaaacgaggacattgcgcgccggttgaagagcgccaatgcggcgatccgcgacatattgggcgaagttgaaaacgaccaatag

SEQ ID NO: 7023 - DNA, 321 bp, Methylobacterium chloromethanicum CM4
atggcgcgagcggatacgaaggcagcgcagggcagaaggcaggacggcgtcgggctggaagaggcgctgcaccggctcgatacggcgctggcgctgctcgagacggcggtggcccgcaagctcgaagccgagcgcagccgcggcgaccgggagacggagttcgccctgctggaggaggaccgggtgcggctcgccgccgaactcgatgcggcgggcgcgcggcttgcccggatgaattcgaccaccggcgaggtcaaccgccgcctcgatcgcgccatcgagacggtggaagacgtgctgtccggcccgtccgggcgctga

SEQ ID NO: 7024 - DNA, 282 bp, Methylobacterium nodulans ORS 2060
atgagtgcagcgatggaggatgcgctgcgccggctcgaagccgcggtcgccctgctcgatgccggcgtgacccgacggctcgacgcggagcgcagccgcggggatctcgaagccgaactcgccctcatgcaggaggatcgcgctcgcctcgcggccgagctcgacggcgcgctcgcgcagctcgcggaggccgtggcggtgaccgacgacgtcgagcaccggctcgggcgcgccatcggcgccgtcgaaggggtgctcggccgcagccgcgcggacggatag

SEQ ID NO: 7025 - DNA, 270 bp, Agrobacterium vitis S4
atggcgacggataaagcggaagccgcgctcggcgcattgaaacaggccatttccggcctggaaaatgccatagacatgcgactggaactgcaacgcgccaatggcgaggtggagcaggaggtgaagcgcgtccatatcgaccgcgcccgccttgcccaggaacttgaccaatcgcaatttcgcgccaaccggctggaagaggtcaatcgcgaagtctcgcgccgcctggtcaccgcaatggaaaccatcagggccgtactggaccgctag

SEQ ID NO: 7026 - DNA, 276 bp, Rhizobium leguminosarum bv  trifolii WSM1325
atgatgcccacaggcaaaaccatggaagcagcgctcaacgaattgagacaggcgatatcgagcctcgaaaacgccgtcgacatgcgcgtcgaacggcagcgcgagcagggcgagatcgagggcgaggtgcggcgtgtgcacgccgaccgctcgcgcctggcgcaggagctcgaccaggccgaattccgcgccaaccggctggaagaggttaatcgcgaggtatcgcggcggctggtgacggccatggaaacgatccgcgcagttctggatcgctga

SEQ ID NO: 7027 - DNA, 471 bp, Sphingopyxis alaskensis RB2256
atgactgaaaaacgggcccgcaagccgttcaccggctggcatatgacggccattcttgtggctttctttgccaccgtcgtcgcggtcaatttcacgatggcgcgcctcgccatgtcgacctttggcggcaaggtggtcgagaacagctatgtcgcgagccagcagtacaacaagttgcttgcacgcgcagaggcgcaggaccagctgggctggacaccgacggtcacgcgcgaccccgaccggcgcgttcgcatcgacattcgcaaggatggcgagccgctcgcagacctcagcgtcggcgcgacggccagccatccgctcgggcgcaccccacctctcgcgcttcgtttcgtcgccgcggaggatggcgggtggcgttcggtcgagccgctggcggaggggcgccagcggctcgacatcaggatttccaggggcacggacgaggcgcgctaccggatcgacctaaaatga

SEQ ID NO: 7028 - DNA, 510 bp, Rhodospirillum rubrum ATCC 11170
atgtccatggctaaagcccgtccgcgggggtggtggtacccttacatcttcgtcggcgccttcggcgtcgttctggcggtcaatctgaccttgctgtatttcgccaccagcaccttcaacggtctggtgacgaccaccgccttcgaagagggcgtggcctataaccgcgaaatcgccgccgcccgcgcccaggagaccctggggtggacggccaaggcggccctggagcccagggccggcggggtggagggctcttggcccgccgatctcgtcgtcagcttgacctcggccgaaaaccagccgctgctgcgcgatctggccgtgaccgcccagatccgccgaccgacccaggccgggttcgatcaggcgctgaccctgacggcggggacggacgggcgctggcatgcgccgctggtcctgcccttcgccgggcaatgggaggtgcgggtggtggcgacgcgcggtcaggcggtgttccgcatgcgcgatcgtttcgttcttaccccgtaa

SEQ ID NO: 7029 - DNA, 459 bp, Rhodobacter sphaeroides 2 4 1
atggccgagatgaccgggcgcaaggttctggcgatcaccgtgggggccttcggggtcatcatcgcggtgaacctgctgatggccttcaaggcgatctcgaccttccccggcctcgaggtcgataacccctatgtcgccagccagaccttcgatgtcgaacgggcgtcgcagcaggcgctcggctggacgctggtggccgactacgacgaagcggcgcgggaaatcagcctgcgcttcaccggcgccgatggccgccccgcggcggtcagcgcgctcgatgtgctggtgggccgcacgacagaagcgagcgacgaccgccagcctgagttcgtgctgcgcgacggcgccttccgcgcgccgcaggatctcgcgcgcggcaagtggatgctgagggtggaggccacgtcgccgagcggcaccgccttccgccaacgcctcgatctcttcgtcgaggactga

SEQ ID NO: 7030 - DNA, 459 bp, Rhodobacter sphaeroides ATCC 17029
atggccgagatgaccgggcgcaaggttctggcgatcaccgtgggggccttcggggtcatcatcgcggtgaacctgctgatggccttcaaggccatctcgaccttccccggcctcgaggtcgataacccctatgtcgccagccagaccttcgatgtcgaacgggcgtcgcagcaggcgctcggctggacgctggtggccgactacgacgaagcggcgcgggaaatcagcctgcgcttcaccggcgcggatggccgccccgcggcggtcagcacgctcgacgtgctggtgggccgcacgaccgaagcgagcgacgaccgccagcctgagttcgtgctgcgcgacggcgccttccgcgcgccgcaggatctcgcgcgcggcaagtggatgctgagggtcgacgccacctcgccgagcggcaccgccttccgccagcgcctcgatctcttcgtcgaggactga

SEQ ID NO: 7031 - DNA, 504 bp, Sinorhizobium medicae WSM419
atgagcacggcaacgaaacagtgcagtccggagcgcggattcaccggttggcacatggtggcggtcatgagcctcttcttcggcaccatcatctccgtcaacctcgtcatggcctggaacgcaagccgaagctggagcggccttgtcgtagagaacacgtatatcgctagccagcagttcaacggcaaggtagccgagggtcgcgcctttcaggccagcggcatcaaggggcggctaacggccggacgcgacgcagtccgctacgtccttacccgcaacggagaaccggagcgacaaatcgacaaggttatcgccgttttcaaacgaccggttgaggagcatgaggaccttcgcgtcgagctccaccctcggggcgagggcgtttttgttttgggtgaagagctgcgggccggtcaatggatcgccgccatgacggccatggagggggatgcggtggtccaccgtcacactgtacgcttcatcgcagagggaagagacaaatga

SEQ ID NO: 7032 - DNA, 498 bp, Ochrobactrum anthropi ATCC 49188
atgtcgatcaagtcgaaaacctcaggcacgtttaccggctggcatatgctgggcatcatggtcgctttcttcggtgtcattatcgccgtcaatctgaccatggcctataatgccatccatagctggagcgggctggtggtgaagaacacctatgtcgccagtcaggagttcaacgacaaggcacagaccggcaaggagcaggccgcgctgcaatggcagtcgaagcctgcttttgaaagcggcatcttcacctggcagctggccgatcgtgacggcaaggccgtcgccatgaccggcggcacggttgagttcaagcgcccggtcggcgatgtgcacgacaccaaggtcacgctgacagtccgcgagcccggcgtgctgaccgctccgctggaactgggcgagggtgcatggatcatggaagtgaatgccgatgccggtcttgaagacccctatcgccacatcatccgcgttcttgtgaaggacgggaggatactatga

SEQ ID NO: 7033 - DNA, 519 bp, Xanthobacter autotrophicus Py2
gtggcacatcaggacgtcgcccatgccgatgtcccccgccggccgcgtgagctgaccggccgggcggtgctcttgatcctcctcgccttcttcggcgtggtgatcgtggtcaatgtcatcatggcgcgcttcgccgtcgccacgttcgcaggcgtggagacggagagttcctacaaggccgggctcgccttctcggccgagcatcgcgccgccgaggcgcaggtcgcccggcactggaacgtgaacgtggaactggcttctccgggcaatgaggcgcgggtggtcaccatccgcgtgctcgatccctcggggatgccgctgtcgcagctcaccccggacgggcgttttgcccaccccaccgacgcccggcgcgacgtggacctggacctgaagcccctcggcgacggccgctaccgcgccacggcggtggcgggacctggtcagtgggatctggtgattgattttgcgcaaggcggagagcggcaattccggtccaaaaatcgcgtgcagcttccgtaa

SEQ ID NO: 7034 - DNA, 468 bp, Dinoroseobacter shibae DFL 12
atgagcaagtcgcaggaaaaggaattcaccgggcgtcacatgctgatggtcatgctgggcgcgttcggggtgatcatcaccgtcaacctgaccatggcctataacgcgatcggcaccttccccggcctggaggtcaagaacagctacgtcgccagccagaatttcgacaagaaccgcgcctctcaacaggcattgggctggaccaccgatgtgcggctcgacgacggggtgctgcacctggtctttaccgacaagcagggccagcccgtgcgcgcggagttgctcagcgtcacgctcggccggtccacccatgtccgcgacgaccagacgccgcccttccgctggaccggccgcgacttcaccgcgccggtcgacctggacgggggcaactggaacatccgtctcgtggcccaggccgaggacggcacgcagttcaggcagcgcatggtcttttacgtgaagggatga

SEQ ID NO: 7035 - DNA, 501 bp, Rhodopseudomonas palustris TIE 1
atgagccgttcgaaatcatcgccgcgtcctctcaccggcaaagtcgttctcgccgtgctggtggcgttcttcggcatcgtgttcggcgtcaacggactgatgatgacgctggcaatcaagacgctgccgggcaccgaagtcgacagtgcctacgcagccagcctcgcttacgagcgtgagatcgcagccgcgcgtgatcaggatcagcgcggctggaaggtcgaagccaaggtcgagcgcaagcccgatggcgccgccgtgctgcaggtcgaggcccgtgacaaggccggcctgccgctggccggtctgaacttcttcggccggctggagcggccgtccgacaagcgctacgaccgcgaggttgcgctcgcggaggtcggcagcggcgtgtaccgcggcgacgccgatggcgtgctgccgggccgttgggatctggttctggaaggggatcagggcggcgttcgcatgttcctctccaagaacaagctgctgttgaactaa

SEQ ID NO: 7036 - DNA, 501 bp, Methylobacterium sp. 4-46
atggcgagcacgatgtccccccccggcgcgcccctcaccggccgccgcgtcctgatgatcggcctcctcttcttcgggacggtcgccgccgcgaacgcgttcctggtcacgtcggccctgcgcacctggtcgggcctcgacgagaagtcgccctaccatgccgggcaggtctacaacgcggagatccgcctcgcccgcgcccaggccgagcgcggctggcacttcgccgccgaggtcgcgcgcgccggggcgggggtcgccgtcacggcccgcctgagcgaccgcgccgaggcgccgctcccggggctgcgggtcgaggcgcggctcgagcgcccgaccgacaagcgccaggacgtcgtgctccccctctccgaggcgcggcccggcacctatgcggggcgggccgaggcggtgccgcccggccagtgggacctcgtggtcgacgccgccgacgcgaccggccgggtcttccgccgccgcagccgcctcgtcctcgactga

SEQ ID NO: 7037 - DNA, 510 bp, Methylocella silvestris BL2
atgtcaaagcgggatctttcgttccccgaaatccgtgggccgctcaccggctggatggtgttcgcgatgacgctcgctgctttcggagtcgtcttcgcggtcaatgggttgatggcctattacgccgtctcgacctttacggggctcgccgacccgagcccctatgagcatgggctcgcctatgagaaggatatccttgccgccaaggcccaggacgcgctcggctgggacgtctccgcccatctgacgcgcgacgccagcggcaaggaggcgatcgaggcgcgcttcaaggatcgtggcggcgctccggtgccgggccttgcggtctctgcaggatttgactcgcccgccgacataaagctcgacgccgatctgacgctgaaagaaatcgaacccggcgtctatcttggcctcgttgcggcaaggccgggccaatgggatctcttgattgacgcgcgccgcgacggagagcgcgtgttcaaatccaacaaccgcgtcgagatacgctag

SEQ ID NO: 7038 - DNA, 495 bp, Agrobacterium vitis S4
atgagtgctgacagccccaaaacctttactttcacaggctggcacatgctggcgacaatctgctccttctttggggtgatcatcacggtcaacctgaccatggcctggtatgcgggccatagctggagtggcatggtggtgcaaaacacctatgtcgccagccagcaattcaacgacacgacagcgcaaatccgcaagctgctggatacgggcatccagggaacgatgacgataaagcagggggccattgcctatgatctcgccattcccggcaagggtcctgtgattgccgatcaggtggtcgccaatttcaagcgcccggtcggtgagcatcaggatttcaccgtcatgctgaagccagccggtcccggacacttcaccggcgaccatcctgttgatgatggccattggatcgtcgagaccattgcaacgcgtgatgggcagctggtcatgcatgaagccaaccgtatggctgtcatcgggggtgaaaaatga

SEQ ID NO: 7039 - DNA, 486 bp, Rhizobium leguminosarum bv  trifolii WSM1325
atgaagacctccgctcaaggttttacaggcctgcacatgctgcttgcgacctcggcattctttggcgtggtgatcgcggtgaacgtcaccatggccttctatgcctcctccagctggagcggtctggtcgtggaaaacacctatgtcgccagtcaggagttcaaccgcaaagcggcggcgatgaaggcaatggccgcttccggcatcgagggcaacctctccataaaggggcacgagatccgctacgacattcacgacaagagaggatcgcctgcgatcgtcgacgacgtcgttctgaatttcaaacggcccgtcggagaccacgaggacttcctccttacgctcaagaaggcagccgcggggcggttcgaagcggaacatgatctagccgaaggtgactggatcgtcgaggccatctcgcgcaacggcggcgtggtcgtcatgcatgaggcaaaacgcatcgatagcgcggagttggaccaatga

SEQ ID NO: 7040 - DNA, 351 bp, Methanosarcina barkeri fusaro
atggtatccaaacagcctagaaagcagagaaaggcaagatataatgcgcctcttcacgtcagacagaaattcatgggcgcaaggcttagtgaagcactctctaaggagtacggcacaagaagcgccgcagttatagcgggagacaccgtgaaggtcatgcgtggagattataagggtactgaaggaaaggtccaggccgtttcgcttcaggacggcacaatttctgtggacggagttatttccaccaaggtggatggtaccgaagtcccaagacctatatacccctccaatgttatgatcacaaaactggaactgaaggacgagcgcagagcatcaagtattaagaagtga

SEQ ID NO: 7041 - DNA, 363 bp, Methanospirillum hungatei JF-1
atggtacgagtaattagcagtcaacccagaaaacagagaaaagcccggtacaatgctccgcatcatatgcgtggctcactcctgcatgcagccctttccaaggaactgcaggggaagtacaagcgccggagcatccgcgttatcaaaggcgacacagtaaaggttcttcgtggggatcatgccggaactgaaggactggttgactatgtcatcaccagagatgcacgcattgtggttgatggagtatcagtcaagaaggcagacggtacagaagttccccgtccggttgatccatcgaatgtgatgataaccgatctgaatcttgaggacaagcgacgtgaacagaaactgagtggtgagtaa

SEQ ID NO: 7042 - DNA, 354 bp, Methanococcoides burtonii DSM 6242
atggtatcaaaacagccaaggaaacagaggaaagcacgttacgaggctccacttcacatgaagcagaagtacatggcggcacctctgtcaaaggcccttcgtggtaaatacggtcgcagtgcaaatgtcattgtaggtgacactgtaattgtgatgcgtggtgaccatgcaggtactaaaggaaaggtcgaggcattatccttgaagagcggaacaattgttgtagaaggtgtttctgtcagcaaggtggatggaaccgaggttccaaggccgatctatccttcaaatgtgatgatcacatcactagaaatgaatgataaacatagagattcaatattatcaagaggtaggtga

SEQ ID NO: 7043 - DNA, 351 bp, Methanosaeta thermophila PT
atggtcagcaaacaaccacgtaagcagcggaaggccagattcaacgctccgctccacatgagacagaggttcatgcacgcgatgctgagtcccgagctcaggaaagagtacaagaagaggagcgctcaggtcaagaaaggcgatacggtgaaggttatgcgtggcgataacgcgggcgtcgagggcgaggttctgagtgtggatctgaagagatgcgtgataacggtcgccggcgtcagcaacttccgtgctgacgggacagaggttccacgccccatacatccatcaaacgtcatgatcacgaagcttgatctcgacgacgatgagcgcgagaagatattctccaggtga

SEQ ID NO: 7044 - DNA, 396 bp, Thermofilum pendens Hrk 5
gtggtcaagggaacatcgtcgaagccgggaaaggtacgcaagcgggaggtatacgatgcaccactgcatataaggtcaaaaaaaatagtcgcaccgctgtctgcagagctacagcaaaaacttgggattaagaggattcgcgtaaggaagggagaccgagtattaattgttagggggtcattcaaagggcatgagggaaaggtgacctccgtggatgtgaagaaggggcgtatccacgtggagggcgccacgcttcgcaaggctgatggaactgaagtccccttcccgatacatccctcgaaggtcgtagtcacggagctcgacctatccgatcctaggaggaaagaactagtagaaaggaagaagcaggtggtcgtgagtgggcaggaaggttaa

SEQ ID NO: 7045 - DNA, 372 bp, Pyrobaculum islandicum DSM 4184
atgccgtttactacatctatacagcctagacgacaacggcttagcctatacacggcgccgctacatttaagacataagctattcaatgcaaagctctcacctgatttacagaaaaaattgggcgtaaaaagacttcctgtaagacgcggcgatacggttatgataatgagaggggatttcaaaggtgttaccggcaaagtcgttaaagtagatcttaagaaggtgagaatatatgtagagggagctaccaggacaaatagcaagggtcaaaccgtgtattacccaatacatccctctaaagtgatgataatagatatcgatacatcggataagattagacagaaaataatacagagaagaaagaaggagtag

SEQ ID NO: 7046 - DNA, 366 bp, Methanocorpusculum labreanum Z
atggcacgtatttcaagcactcagccaagaaagcagcggaagttccggtataatgctccgattcacactcgtggtgcatttttacactcccctctcgcaagcgatcttcgcgaaaagtatggaaagcgcagtttccgtgttgttaccggcgatactgtcaaagtacttcgtggtgaattcaaaggaatcgaaggcgttgttgacggcgtagacgtcaaaaacacgaaggtccttgttcacggagtttatgtcaagaaagccaacggcgaagatgtcccaagaccactcgatccgtccaagataatgatcaccaaactcaacacaaaagatgcagtgcgtgttgcacgtcttgaggtgaaggcataa

SEQ ID NO: 7047 - DNA, 366 bp, Methanoculleus marisnigri JR1
atggtacgcatagttagcaaacagccgagaaaacagcgcaaggcgcgttacaacgcaccgaaccacacccggggccggttcctctccgcagcgctctcccccgaactccgtgggaagtacaactcccggagaacccgtgtggtcaagggcgacaccgtgaaagtgctccgtggagactttgccggcgacgaaggcgtcgtcgatgcggtggacatgaaggcgtgccggctggtcgtgcacggcgtgatggtgacgaaggcggacggaaccgaggttccccggccggtcgatccctcgaacgtgcagatcacgaagctcaacctgaaagataaactacgtgaggaaaggctcggaggcggagcataa

SEQ ID NO: 7048 - DNA, 387 bp, Pyrobaculum calidifontis JCM 11548
atgccgtttactgcgtcagcacaaccgcgcaaacaaaggctgagtctatacgccgcgccgctccaccttaggcgaaaactgttaaacgcaaaactatcgcctgagcttcagaagaagctgggcgtgaaaaggttgccagtaagacggggagataccgtgttaataatgcggggagatttcaagggcgtgacaggcaaagttgtcaaagtggatttgaagagggtgagaatcttcgtggaaggcgctactaggaccaatagcagggggcagacggtctactatccaatacacccatccaaggtaatgatcgtagacgtagatctgtcggacaaagcaaggcaaaaacttatagagaggaggaagaggggccagcatggttcatcttag

SEQ ID NO: 7049 - DNA, 360 bp, Methanococcus maripaludis C5
atggttttgacaaactcaaaacagccaagaaaacaaagaaaagcactctataacgcacctttacatttaagaaatagcgttatggctgcaatgttatcaaaagaattgaaagaaaaattcaataaaaactcccttcctgtgaaaaaaggagatactgtaaaagtactcagaggaaatttcaaaggaattgaaggggaagtttcaaaagttgactacgcaggatacaaaatcattgttgaaggagtagttaacaaaaaacaagatggaactgaaacagcatatccaattcatccatcaaatgttatgattaccaaattggacgaatcagacgaaaagagatttaaaaattcaagtaactaa

SEQ ID NO: 7050 - DNA, 369 bp, Pyrobaculum arsenaticum DSM 13514
atgcctattaccacctcggcacagccaaggaagcagcgtcttgccttgttcaacgcgccgctccacttgcgacataagctattcaacgccaagctatcgcccgaactggaaaagaagcttggggtgaagagacttccggtgaggagaggcgacacagttatgatactgaggggcgactttaagggagtcaccggcaaggttgttagagtcgatttaaaaaaggtgcgtatatacgtagagggggccacaaggaccaacagccggggccagactgtgtactaccctatccaccccagcaaggtgatgatagttgacgtagatatgtccgacaaagccaggcagaagataatagagaggaggaagaagtag

SEQ ID NO: 7051 - DNA, 336 bp, Metallosphaera sedula DSM 5348
atggtatcgtctaaactgattgcccctctttccgatgagctagcgaaggaatatggaatgaaaagaatcggtataaggaaggatgatactgtgagagtaatgaggggagataattacggctttgagggaaaggtgactcaggtgttccctgagtctggtagaatagctattgaaggtctgactaggaagaaggcagacggcactccagtctacattaagattcacgcttctaaggtagaaattactaagttgaatacaaatgatccaaggaggaaagacattataaataggaaagcttcaaggcagaaagaggagcaaggaggtaaggctcaatga

SEQ ID NO: 7052 - DNA, 360 bp, Methanococcus vannielii SB
atggttttgacaaactcaaaacagccaagaaaacaaagaaaagcactctacaacgcaccattacatttaagaaatagcgttatgtctgcaatgttatcaaaagcattaaaagaaaaatacggtaaaaacgccctacctgtgaaaaaaggagatactgtaaaagttcttcgtggaagtttcaaaggaattgaaggcgaagtttcaaaagtcaactattcaggatacaaaattattgttgaaggagtagttaacaaaaagcaggatggaaaagaaacgccgtacccaattcatccatcaaacgttatgattacaaaaatggaagattcagacgaaaagagatttaaaacatcaaataaataa

SEQ ID NO: 7053 - DNA, 360 bp, Methanococcus aeolicus Nankai-3
atggttttgacaacttcaaaacagccaagaaaacagaggaaagcattatataatgctccactccatgcaagaaacaaattgatgagtgcaatgctctcaaaagatttgaaagaaaaatataacaaaaatgcacttcccgtaaaaacaggagacactgtaaaaatactcagaggaaccttcaaaggaatagaaggggaagtatcaaaagtagattacaaatcctataagatatatgttgaaggagcagtaaatagaaaacaagatggaaatgaatctctctatccgatacacccatcaaatgttatgattgttaagatggacgattctgacgatagaagatttaaattttcaaataaataa

SEQ ID NO: 7054 - DNA, 360 bp, Methanococcus maripaludis C7
atggttttgacaaactcaaaacagccaagaaaacaaagaaaagcactctataacgcacctttacatttaagaaatagcgttatggctgcaatgttatcaaaagaattaaaagaaaaattcaataaaaactcccttcctgtgaaaaaaggagatactgtaaaagtactcagaggaaatttcaaaggaattgaaggagaagtttcaaaagttgactacgcaggatacaaaatcattgttgaaggggtagttaacaaaaaacaagatggaactgaaacagcatatccaattcatccatcaaatgttatgattaccaaattggacgaatcagacgaaaagagatttaaaaattcaagtaactaa

SEQ ID NO: 7055 - DNA, 366 bp, Candidatus Methanoregula boonei 6A8
atggtaaggattgaaagttcacagccgcgcaaacagagaaaggcacggtatgacgctccctcgcacatgaggtccaagttccttaatgcacccctctcggcaacgctccgtgagacctacgaaaagaagacgattcgggtcatcaagggcgatacagtcaaggttacccgcggggaccatgtcggcgaggaaggaatcgttgacgggattgacacccgcaacgtgaagatcattgttcacggggtctcatcaaccaaggtagatggtaccgaagtcccgcgcccgatcgatgcatccaaagtcgagatcaccaagctcaagcttgatgacaagcgccgcgttgaaaaacttgggggtaaggagtaa

SEQ ID NO: 7056 - DNA, 432 bp, Caldivirga maquilingensis IC-167
atgcctgtgttaacatcatcgagtcaacccaggaagcagcataaggcgcttactaaggcgccttggcatgctaggcgtaggttattgactgcaccattatctaaggatcttcagaggcagttgggtataaggaggatacctgttagggttggggataccgtgctaatactgaggggggactttaagggtactaggggtaaggtgactagggttgattataagagagtgaggatatacgttgactcggcttcatttaagaaacccagtggtgaggctgtgtactacccaatacacccatctaaggtagttatcgtggagcttgatcaaagcgataaggctagggttgctgcaattgataagactaggaaggctagggaggctaaggcgggtgttagggaggttataacaccacagcagggtggtcaatcatga

SEQ ID NO: 7057 - DNA, 360 bp, Methanococcus maripaludis C6
atggttttgacaaactcaaaacagccaagaaaacaaagaaaagcactctataacgcacctttacatttaagaaatagcgttatggctgcaatgttatcaaaagaattaaaagaaaaattcaataaaaactcccttcctgtgaaaaaaggagatactgtaaaagtactcagaggaaatttcaaaggaattgaaggagaagtttcaaaagttgactacgcaggatacaaaatcattgttgaaggagtagttaacaaaaaacaagatggaactgaaacagcatatccaattcatccatcaaatgttatgattaccaaaatggacgaatcagacgaaaagagatttaaaaattcaagtaactaa

SEQ ID NO: 7058 - DNA, 507 bp, Nitrosopumilus maritimus SCM1
atgaaaccaactaaaatgcgtaacaagatgatttatcgtgcatcttaccaaacaaaaagtaaacaacttggtagtgcactatcaaaagatcttcagaaaaaatatggaaagagaagtgtcagagtaaatgaaggagacagtgttacaattcttagaggagaattcaaaggagtagatggtaaagttgcagaagtatctacagcgaaaagtagtgttgcaattgaaggagtaaagaaagaaaaaacaaaaggagacaaatttgatgtattcattcacacttcaaacttactagtcacatcattaaacacagaagacaaatggagaatagcaaaactcgagggtaaagacccaagaaagcagcctaaagaagcaccaaaagcagctgaaaaaccagcaaaagaggaaccaaagaaagagactccaaaagcagaagaaaaaccggccaaagaagagcctaaagaaacaaaagtagagaaaaaatccgaagaaaaggaagatgagaattaa

SEQ ID NO: 7059 - DNA, 369 bp, Thermoproteus neutrophilus V24Sta
atgccgtttaccacctctgcacagccgaggaaacagaggttgagcctatacaaggcgccgctacacctccggcacaagctcctcaacgcgaagctttcgccggagctgagcaagaagctcggcgttaagaggttgcccgtgaggcgtggcgataccgttttgatactaagaggcgacttcaaaggcgtaacggggaaggtcgtcagagtagacctaaagagggtgaggatatacgtagagggcgccactaggacaaacagcaagggccagaccgtttactacccaatacacccgtcgaaggttatgatagtcgaggccgatacctcagataaggtaagacagaagttgttggaaagaaggaagaggtag

SEQ ID NO: 7060 - DNA, 357 bp, Halorubrum lacusprofundi ATCC 49239
atgacgaaacagccacgtaaacagcgaaaacggtcggagaccgcgccgctccacgagcggcagaatcaggtccgggccaccctcacggacgagctccgtgaggagtacggccagcggaacgtccgcgtcaacgccggagataccgtcgaggtacttcgcggcgacgcggccggcacggaggccgaggtcatctcggtcgacctgtccgcagaacggatcaccgtcgaggacgtcaccgtcgagaaggcggacggggaggaagttccccgtcccatcccggcgagcaacgtccgggtggccgaactggacctggaagacgagcgccgggaggcgcggctccaggaggataacgaatga

SEQ ID NO: 7061 - DNA, 360 bp, Halorhabdus utahensis DSM 12940
atgagtgaacaaccaaccaaacagcgcaatcagaccgaacgcgccccgttgcacgagcgacacgaccaggtgcacgcgacgctgaccgaggacctccgcgaggagtacggacagcgccgcgtccgggtcaacgcgggcgatacggtcgaggttatgcgcggggacttcgccggcgaggaaggcgaagtgctcgacgtggatctccgggacgcgacgatcagcgtcgaggatgtcacgctcgagactgccgacggcgaggaagtgccccggcgactcgaggcgagcaacgtccgcgtgatcgacctcgacctctctgatgacgtgcgcgagcaacgactcgaatcggaggatagcgcatga

SEQ ID NO: 7062 - DNA, 369 bp, Candidatus Methanosphaerula palustris E1 9c
atggtacggattgcaagtaaacagccaagaaagcagcggaaggcacgctatgatgccacccagcatcagcgcagcgcgatgctcggtgcaccgctcgctcctgcactgcgggagaagtacgatggcaagagaaccctccgcgtggtcaccggtgataccgtcaaggtgctccgtggcgactttattggagaagagggtgtggtcgatggtgtggacaccaggaccagtaagatcattgtgcacggggtttcggtcaccaaagcagacgggacagaagtgccacgaaaggtggacccgtccaatgtgcagatcataaaactgaacctgaaggatccgcgcagagccgcgaaactcggggaggtagcataa

SEQ ID NO: 7063 - DNA, 363 bp, Halomicrobium mukohataei DSM 12286
atgacacgacaaccatccaaacagcgcaagaacgcacggcgtgccccgcttcacgagaagcaaaagcaggtgcgagcgacgctggccgacgacctccgcgaggagtacgaccagcgatccgttcgcgtcaacgcgggcgacaccgtcgaagtgctgcgcggcgactacgcaggcgaagagggcgaagtcgtcgaggtcgacctcgacgacgccgccatctacgtcgaggacgtgaccgtcgcggcagccgacggcgaggacgttccacgcccgctggacgcgagcaacgttcgcgtcacggagctggatctcgacgacgaccgccgcgaggcgcgcctcgaatccgaggaggacagcgcatga

SEQ ID NO: 7064 - DNA, 276 bp, Moorella thermoacetica ATCC 39073
ttgccccaggccgaaggccaggtggcggctcaggaccgcaccacagtgaatattaacggccaggactacgtagttaaaggggaagccccggaatatatccagatgctggccgcctatgtggataaaaagatgcgtcaggtaaaccagaaattcccccactattcgcccgtgaaggtggccgtcctcgccgcgttgaatattgccgacgagctctacaaagtacagcaggattacgacaccctggtgaaattgatacaggaggaaaaacagggttga

SEQ ID NO: 7065 - DNA, 270 bp, Candidatus Desulforudis audaxviator MP104C
atggccgggcaaacgaacagagtcgaggttgaaatttttggagaacgttacgtacttcggggggacaggcccccggactacatccgctttattgcccaggacgttgaccggagggtacgggacatctgcaaccgccactcccggatcccggtgaccacggcagcggtcctggccgccgtcaacctggcggacgagttaaaacgcctgcaggagagctacgacggcctagtgaaaatgatcgagggggaagacaaggaaaagaagaagtag

SEQ ID NO: 7066 - DNA, 303 bp, Natranaerobius thermophilus JW NM WN LF
ttgggtgtaaagggggtagctagattgagatctgatagaagacatcgcattgaagttaatatttttggtgaagaatatactttaaagagttcttcaaatccagagcatatgaaaaaagtggcttctgtagtcgatgaaaccatgaacaaaattgcagaaagcaaacctagaattagcctacatcagatagctgtgttggcggctttaaacttagccgatgaatacttaaagcttgaagacgaacataccgatctattggaaatgttagacgagaagggtgaaactgataagggtgataattga

SEQ ID NO: 7067 - DNA, 258 bp, Desulfitobacterium hafniense DCB 2
atggctgaagaaaatgaaaaggtcattgttgagatatttggggaaaaacatgtgattcgcggacaggaaagcccggagcatatcctgaaggttgcccgtgaagtagataaaaagatgcgtctcattgcccaacggacaccgcgcttagccattcatcaaatcgccattctggccgcgctgaatctagccgacgagttggaaaaaatcaaggaagaacaagaaactctcatgcagctcattgaagcgcaagaagaataa

SEQ ID NO: 7068 - DNA, 363 bp, Halothermothrix orenii H 168
atgccaaccggggacaagtccagtaaggggaaagcaaaaaaatataaggttaatgtactcggtgaagagatgacagttgtagctgatgttaccgaggaatatattgataaactcatagagtacattaatgatatcggagaggctataaccagggcctatcctggtttaccccgaaggagaattacagggttgacactaattaatatggctgatgagtattataaattaaaaaaggtatatcgtgacagaattaaggaaataaataatcttagagaggaaaataaaaaactccaaaataagattaatgaaatggaaatagaacaaaaagaactaatttcgttgctggaggaggtcgaccagtag

SEQ ID NO: 7069 - DNA, 309 bp, Desulfotomaculum acetoxidans DSM 771
gtgccggaagaacctaaccgtgtaaatatagaaatatatggagaagagtatatcctgaaaggaaacgaatccatagagtatatgaaaaaaatagcccagcatgtcaataagatgatgaaggatatatccaaccgtaatttcaaattgcccctcaataaagtagcaattcttgccgcaattaatattgctgatgattattttaaacttatgagaaaatatgaagaattaacccatgaaaatcaggaattgattgaggaattgacaaaccctgagccggtaaaagataataagaagggtgttattaagtaa

SEQ ID NO: 7070 - DNA, 288 bp, Alicyclobacillus acidocaldarius DSM 446
atggacaacaaccaagaaggcgcaaaggtcaatcgcgtgaaggtggtcatccatggcgtcgaatacacggtgcgcgggacgagtccggaggagcgaatccaagaagtggccaaaatggtggatcggacgatgaacgagatcgccgccacggcctcctacatggatgagcgtcggatcgccgtgttggccgcgctcaacttggccgacgagctttacgagctgcgaaaggattacaaggagctgttggcgctgctcgaagagcagacgggaggccgttcgtcgtcgtga

SEQ ID NO: 7071 - DNA, 279 bp, Syntrophomonas wolfei Goettingen
atgagactggtaaagatttattaccatagtaaggaagaagaaattccactcagctggctcaacctgcacccggatttattaaagattatggaagaaatggggataatagagctggccggtgatagcattaaagctgatggcctgcaaaagatttataagatgatgcgcctgaaaaaccttctgggggttaactttaatggcgcagctattattgtagatttactggagcgtatcgaagaactggaagatgaaatcgaagaactgaagagaaagaggtga

SEQ ID NO: 7072 - DNA, 333 bp, Syntrophobacter fumaroxidans MPOB
atggtggaaaagcgttatttcatgatcaatgtcaaaacggtcacttcctcttcgccgttcctgacccggaacgaacttgccgtgcattgtggaattcatcccgacctgatcgaccggtttattcgactcgggctgattgatttcatggaccgcgatagcgatggagaggccgtgttttcagccgaagtgattcctctggtgagaagaattctgaggcttcgcaacgaactgggtgtgaactacgcggggataggagtggtgctcgaacttatggcccgcgtggaaacactggaaaaccatataaaggaactggaaagcagaatcttcgcctga

SEQ ID NO: 7073 - DNA, 315 bp, Frankia EAN1pec
atgaccatgacgctcgtccgcacccgcccgcgggaccgcgagctggacctggagtccttctgcgccgccgcccagctgcaccccgacctcgtccacaggctggtgacgctcggcctgctcgacgccgggcccgggcccggcgtcggcggccgcagtgtcgtgctcgcggcgggcgcgctggcgcgtgtcgggcgtatcgaacggctgcgccgcgacctcgggatcacctacaccgccaccggggtcgtgctcgacctgctcgaccggatcgacgagctcgagcggctgctgcggcaaccccagcggggaaggtga

SEQ ID NO: 7074 - DNA, 303 bp, Geobacter lovleyi SZ
atgacagtccaacactatgaaattattatcagcagaaagcatgaactggtctccgtgccggggataaccatccatgagttgagcaggctgtgcgattgtcacctgacggtggcgagacggctcttctcaatcggcctcattgaaccgttgactgccggagatactccgctgtttgatcaaagcgccgtggttcgggcacgcaaagcactgcgactgaaacgggacctgcggctcaatttcgatgccattgccctggtaatggatttacttgaccgcatcgacgaactggaacgacgaatataa

SEQ ID NO: 7075 - DNA, 312 bp, Micrococcus luteus NCTC 2665
atgacctcacgtcacctgcccgtccgtgtcgcccgggccgacctggcggcgaccgcggtggccgcaggtatccacccggatacgctgcggaagttcgtcgagctggggctggtcaccgcccacgtcgacaccagcggccggctgtggttcgcccgtaccgtccccgcccgcgtgcacaccatcgtgcgtctgcactccgatcttgccgtgaactacgccggcatcgcactcgtgctcgacctgctcgcccgcatcgagcagctcgagcagcaccggaccatccgacttgaaggagacatcccatggacatga

SEQ ID NO: 7076 - DNA, 369 bp, Catenulispora acidiphila DSM 44928
atgacccccgcgaacgacatcgggcagcccggtggcggccgtcgctatccgctcgtcgtggtgcgccgcgcgtcccagggccggctgaccctcgaggacgtggccggccgctcgggcgtcacctcccagctgatccgccggttcgtcgcgctcagcgtgctcgacgcccagcgcgacgacgccggacagctctggttcgacgcgcgcgccccggcgacggtcgcccgggcactgcgcctgcacgccggcctcggcctcaactacgcctccctcggcctcgtcctggacctgctcgaccgcatcgaccagctggaatcagcgctgcgccgcagcgggcgcccggcgaaggagttcccaccatggacatga

SEQ ID NO: 7077 - DNA, 321 bp, Nakamurella multipartita DSM 44233
atgaccgcggtcacgcacttcgccctcgctcgcccgtaccggctcagcctcgacagctttgcgcaggccaccggcgtccatcccgagctggtccgccgcctggttgccctcggactgctggaagtcacccgcgacgcccaggggcgcttgtggttcgacccctcccaggtgagggagatggccaggatccagcggctgcggatgagcctgaacctcggctactccgccatcgggctggtcgtcgagctgctcgaccggatcgcggtgctggagaaggagcaacggcgaatgtcacgacgaggaggcgttccatggacatga

SEQ ID NO: 7078 - DNA, 777 bp, Syntrophomonas wolfei Goettingen
gtgaaaataatagcgaccaccacccaatcgcaaactacattatgctctgaatataagcagtttctggaggaaaccggcctgccttttattccccgggaacgaagaagcctacaggctattgcccaggaacaagaggcccaggccgtgctggtttggcaggccagcggaccggtattgcatatgggagatgaaagcttctttttccatcccagtatggccaaaaaccgcatagcttcatatcgcaaattaggtacggctgaccccttgattaaagcctgtgccttagaagtgggcagcagctttttggattgcactctcggcctgggagctgattctatagtagccgcttattatgcccatgaaggcagggtagcaggtttggaatcttctccgctaatcgcggccatagtaaagtgggggatgaaagtatatcattcgaatatgagctggctggatcaggctatacattccattcaggtagtaaatgcggagcattatgattatctccggaaactagaggataattcctttgatattgtttattttgaccccatgttccgtaaaccacggcataaaagcaccgccctggcgcctttaaggctgctggccaaccatcaagccttgagccgggaagttatagccgaagcctgccgggtagccagaaaacgggtagttgtaaaagagatgccggtaagccgcgagtttgaacggctgggaatagagcagcttatggaaaatcccaataatcccatagcctttggggttatagaagtatga

SEQ ID NO: 7079 - DNA, 798 bp, Desulfotomaculum reducens MI-1
atgaatgattcccttgttatcaccactggaattagaagcaggaaaaacctggaggaaaaggccctggaattaagtagagagtggaagataccctatcaaccaagggagaaatattcactggatttcattagagaaatgacaggtgcttccactatattattggtcagccaccagaaactttctttagttaccaatggaaaagaattcttttttcatccaggattagctaaattacgtataaaggaactacaggctgggaaaactgaccaaatgataaaagcaatggacctccaggaaggagactccctgttggattgtaccctgggattggctgctgatgccttggtggccagttatgtggtgggaaccaagggtatcattgtagggttagaggatgctgctccagtggcgcatattattgctcggggccttagaagttataccggtgaaaagccggaattgataaatgctatgcgtaggatacaggtggttaaccaacatcatttgcattatcttcgcaatctacccagcaacacctttgatgttgtttattttgatcctatgttcagggtaccaaaggttaaatcaagttcgatggctccattacgagatctggccaatagcagtcctttgtccattgaagctgtggcagaggcagtccgagtggctaggaagagggtggtcatgaaggagaacagagaaagccaagaatttcaacgactaaactttcaactgatccaggggggaagatattccccggtggcctacggtgtaataaaaggcggtgttttaaaatag

SEQ ID NO: 7080 - DNA, 765 bp, Thermotoga petrophila RKU-1
atgaaaaacttcgtggtcacaacctcacacaaaccggacagggagcaggtaatgaaagcgaaggagctcgctgaaaagctcggcaccatctacgtttcaagaaggagattgaaagagttcaaagtggacttttactacgtggtggagaagaacagaatctcaataaaatggcccggaggagagttcttttttcatccttcttcggctatcctccggatgaggaacataagaagcggtcagaaggactacctgatagaatcccttcaaccggagggaaacgaaatcgtgctggatacgacctttggtcttggaagcgaagccatcctcatggccgcttttcttcctgagggtaaggtaatcggtcttgaaggatccattcacatatacaccatcgtgaaatacggaatggaaaattttgagactgacattcagtggttgaaagacgctttaaaaagaatagagctttatcacgcgaatttcaaagaatacatcagaagtcagcccgacaattctttcgatgtggtctactgtgatcccatgtttgagaatcccgtgtacgagtcctctgccatgaatcctctgaggcccttcgctgtgtacgacacggtgaacgaagaagacattgaggaaatgctgagaatcgcgaagaagaaggtgatcctcaaaagccacgtgaaggattctctcttcaaaagaatcagggttgacgaactgaaaggttccagaaagagcggtgttctctacggggtgatatacaagcgatga

SEQ ID NO: 7081 - DNA, 771 bp, Petrotoga mobilis SJ95
atggtgaagaattccaccaaatggatctttacaacttcccataagccaaataaaaaacaagtagaaaaagcgttgcaattagccaacaaatacggtggtgtttacttagaaagaaataagctccgaatgaacgaaggggatttttattttgtaatagataagaagctatcgctgaactttcaatgggaggatggaaaattatttttccatccttctgtttccaaaataaggttaaacaattatttaaaaaatggaatcgatcatttaataaacgcagtatctccgaagaaaaacgatattatacttgatttaacccttggccttggaagtgatgccttactactgtcatatttttgtgaaaaagtagtgggcttagaggcttcttttcctatatatgcggttgttgcagagaatataacaaactatgactacaaagaaaattggatgaaagaagcttcaaaaaaaatcgaagtgatcaattctgattataaaatttttttagacgagcaaaaagaaggaagttacgatgttgtatattgtgatcctatgttcgagaatcctcaatacaaatcaagctctatcaatcctttaaggaagtttgcccgatacgataaaataacacgagaagatttagaaaagatgattaaaattgctaagaaaaaagtagtaatcaaagcacgttctaacgacagtgtatgggatttatacagtttcgataaaaaaatcggaagtaaaaaaagtggagtatttttcggagtgattgaaaagtga

SEQ ID NO: 7082 - DNA, 804 bp, Candidatus Desulforudis audaxviator MP104C
atgagccacgccgtgagcatcctggtcacgacctccatccggccgcgccgggcgcagcggttgcaggccgaggagataagccgtacgctgggtttgccgtacgtgtcccgcagccgcgaaagcctggaggccctgcgcagaaaatccggggcggaagcggtggtggtagtgtcccgcaaccgcgtggggctggtgttcgccgggagggagtttttctttcatcccggactgggcaaggtgcgcataagaagaatagaggctgggaaaactgaccagatgatacaagctatggggctcaaggccggggacagcgtgctggactgcacgctgggtctgggggccgacgccttggtcgccagtcacgtggtgggtgccgggggccgggtggtggggctggaagtcgtgcccgtggtcgcgatgctggtgcggtgcggcctggagaattacgcgggcggcggcccgccggccgaggcgatgcggcgggtggaggttgtgacggccgaccaccgggagtacctgcaggctctggagaacgacagttttgacgtggtctatttcgatcccatgttccgggtgccccgtcatgcttcgagcgcgatggaaccgctgcggccgttggccgacgcgcgggcgctcgatccggagtcggttggtgaggcagtccgcgtggcgcgccggcgggtggtgctgaaggagcgggcgggcagccccgagttcgaacgtctcggcttccggcggatcaccgggggccgctattcaccggtggcctacgggatcatcgcaaaggacggggatgaggcgtga

SEQ ID NO: 7083 - DNA, 765 bp, Thermotoga RQ2
atgagaaacttcgtggtcacaacctcacacaaaccggacagggagcaggtaatgaaagcgaaggaactcgctgaaaaactcggcaccatctacgtttcaagaaggagattgaaagagttcaaagtggacttttactacgtggtggagaagaacagaatctcaataaaatggcccggaggagagttcttttttcatccttcttcggctatcctccggatgaggaacataagaagcggtcagaaggactacctgatagagtcccttcagccggaggggagcgaactcgtgctggatacgacctttggtcttggaagcgaggccatactcatggccgcttttcttcctgaaggtaaggtaatcggccttgagggatccattcacatatacaccgtcgtgaaatacggaatggaaaatttcgagactgacattcagtggttgaaagacgctttaaaaagaatagagctttatcacgcgaatttcaaagaatacatcagaagtcagcccgacaattctttcgatgtggtctactgtgatcccatgtttgagaatcccgtgtacgagtcctctgccatgaatcctctgaggcccttcgccgtgtacgacacggtgaacgaagaagacattgaggaaatgctgagaatcgcgaagaagaaggtgatcctcaaaagccacgtgaaggattctctcttcaaaagaatcagggttgacgaactgaaaggttccagaaagagcggtgttctgtacggggtgatacacaagcgatga

SEQ ID NO: 7084 - DNA, 840 bp, Desulfitobacterium hafniense DCB 2
atgaaccacgcaacagtcatcgttaacatcacccatcccagggatccggatttacagaaaaaatttctttggttttctgaacaacccggcattaccttactgacttcctccccgaagtccctggccggggcggttgaggagccgccttatccgatcctccacattacccgcaaaggaatctatctggaaacaggggaccatcctttgcactttcatcccagtatggccttgctgcgggttatgcaaatcattagaggagaaggggatcgttttctggaggccgttgacctccgggcaggggatgtctttttggatgccacattcggtttgggaacggatgccttggtagctgctgttcaagtcggggctcagggcaaggttatcggcatagaacattcgcctattttagcagctctggtgaaagatgggttaaggaccctggctcaaggggattgtccccgtgtccaaaacccggacaaggccaaagcctggcaggtcttggctgaagcggcacagcgcattgaggttctgtggggagaccatcttgagctgctggccggctatcctgcagccttcgccgatgtggtttactttgaccccatgtttcgccacacccgggaaaaaagcgcctccatccgccctctgcatgaggtagccaactcctgctccctgcagggtgaaactgttgccgaagcctgccgtgtagccaaaagacgggtggtgctgaaagagcggaaagcaagccgggaattcagccgcttagggtttgagattcaagaaggggggaactatagtcatgtagactatgggataatccacaaagaaggagccggttcatga

SEQ ID NO: 7085 - DNA, 744 bp, Desulfotomaculum acetoxidans DSM 771
ttgctgttagccgaaagattctgtaaagaactgggttatccgctggtgcccagggaaaaattatccttgcccgccttgattgataagtatcaggttgcaggggttatagtagctgctcccgataaagtattttattatacaggggaagaagaatttttttttcatcccaatatggccgcagtgcgtataaaggatattagatctgggaaaactgaccaaatggtcaaggctatggatcttaggcctggagattctgtgctggattgtacactgggtttcggagctgatgctatcgtatctgcttttgtaactggcacctcaggcactgtgcttggtttggaagtatctccggttattgccgctctggtacgttatggtataaaaaattacaattttaaaagtaaattgctttcttctactatgagaaatattacagtaataaatgccagccattacgaatacttattgcaaacagcggccaatagctttgatatagtatattttgatccaatgttcagacaaccaaagtataaatcttcaaatatgacacctttaagaaagttagctgatttatctcccttgaatcgggatgttttggtagaagctcttagagttgccagaaaaagggttgtagtcaaagaaagacgaggcagctctgaatttgccaggcttggtatagacagaatagagggaggcaaatatgctcctgtagtttacggagtgaagaataaagataatgattaa

SEQ ID NO: 7086 - DNA, 801 bp, Alicyclobacillus acidocaldarius DSM 446
atgacacaagcttgcaagacggacatgcgcatccttgtgaccacgccgctccacccgaaacccgctcaggtagcgcgcgcgtcggagatggcggcttggtttggcggcatcgcggtgccgagacgcggccagagcatcgctcgtttgctcgccgatgcggacgccgtcgtggtggtggccgatccggccgtcgtgcacgtgcgcggcgtcgagcacccgctcttcttccacccgagcatggcatatcaacggctcaggcggctcgagcagggggaacccgatcgcctgctcgcgctcgccggggtttcgccgggcgacgtgatcgtcgacgccaccctggggcttggcaccgacgcgctggtcttcgccgcagcggtcgggccggaagggagcgtcgtgggcatcgagcgctcgcctgtgctgtacgggttgctccgcgcggtgcaggcgtacggttccgaggctcatccacgcgaagccgcgctcctcaagcgggttgcgctcgtccacggcgatcacgccgattggctgcgatcccagcccgaccaaagcgcggacgtcgtgtacttcgacccgatgtttcgcgagcccgtgcaccagtcggcgcacatgcagccgattcggcccgtcgcctgggaagcccccctctctcgagaggccctggaggaggcgaagcgggtcgcgcgcagggccgtgatcgtcaaggaacgtcccaaatcgggcgtattcgaggcgctgggtcttgagcccgaccgcacgacgggccgattcgcgtacggtgtatggaggaggccacgatga

SEQ ID NO: 7087 - DNA, 750 bp, Rhodoferax ferrireducens T118
gtgagtggccgtgtcggtgaggtgcggagtttgcagcctgtgtttgagctgtcgggtgcgagcgtgcattttggccgtgccgcgtcgccggtacgcgctttgtccgatgtgaccatgacggttgctcccggtgagcgggtggcgttggtgggcgccaacggctgcggcaagagcacgctgttgcggctgttgcatggcttggcgctgcccacatcggggcagcttgtgtctgacccggcgtggcgacaagccatgttgtttcaaaagccacacctgatgcgcctgacggtgcaggccaacatcgctctgggcctgtggctgcgcggcacgccctggggcgaggccaaggtgttggccttggcggcgttggcccgggttggtttgactgaattggcccagcgcaacgcgcgccagctctccggcggtcagcagcagcgcgtggccatggcaagggcctgggctttgaggccgcaggtgttgctgctcgacgagcctaccgccagcctggacccgcacgccaagcgcgaggtcgaggcgctgattgaagaattttccagtggaccggatgccatgacgctgatttttgccagtcacaacctcggccaggtcaaacgtctggccagccgggtgatttacctggagcatggccgtgtgctggccgacttgccggtagctgacttttttggcgggtcaatgttgcagcagcagtacccggcggcccatttgtttgtcaaaggagaactggtatga

SEQ ID NO: 7088 - DNA, 723 bp, Mesorhizobium BNC1
atgcgcgctgccccaagcgatcttcctctcgtcctcgacggtgtctctttggcggccggcggcacgaccatactcgaccgcctcaacctcacaatcatgccaggggcgccgacgctgatcgttggccccaatggctcgggaaagacctccctgctgcggctttgcatggggctcgccgctccgtccaagggaactgtgagctggggcggccgaacgcatctgccgcaaacaaggcgcgcgatcgtgttccagaaaccggtgatgcttcgccgctctgccgccgcgaatgtcgcctacggcctcgcgcaggccgggtgtccgcgcgcgctccgcgcccggcgcaccgaagagctgctcgaccgcgtgggattgctcgccctcgcgtcccgccccgcgcgccgcctttccggcggtgagcagcagcgtctggcgcttgcgcgcgctttggcgcgtgagccggaaatcctgcttctcgacgagccgaccgcgagccttgatcccgcagcaacccggttcgtggaagaaatcattctcgccgccgcccaatccggcacgaagatcgtcatggcgtcacacgatctcggccaggtacgccggctcgcgggggacgtcctctttcttgttcgggggcgtatttgtgagcgtgccgacgcagcggacttcctggaccgtcccgctaccccggaagccgcagccttcgtgcagggcgaactcgttatctga

SEQ ID NO: 7089 - DNA, 780 bp, Alkalilimnicola ehrlichei MLHE-1
atgttgcagccagtgtcagacgcggggccgggcccggagtccgccgggcgggtcgagtcggccctgctgcccctggagttgaagggcatcggctttcgccaccgggggcagcccctgctccagggggtcgatctgcggatcggcgggcgcggcaagaccatcgtcatggggccgaatggggccggcaagagcctgctgatgcgcatctgccacgggctgttgacgcccaccgagggggagctggtctggcgcggcccccggggaggccgggccgaggagcggcgccgccggcaggccatggtgttccagcgtccggtgatgctgcgccgctcggcactggccaacgtgacctttgccctcgcggcgcagggctaccgccggcgtcaacggcgagagcgggccatggccgcactgacccggttcgggctggcgccgctggcgcggcggccggcgcgggtgctctccggtggcgaacagcagcgcctggcgctggcgcgggcctgggcgttggagccggaggtgctgttcctggacgagcccaccgccgcgctcgatccggccgccaccaaggcggtggaggaggcggtggcggggttcgaccgccggggcacgcggatcgtgatgaccacccacgacttgggccaggcccggcgtctggccgatgaggtggtcttcatctgtggcggtcggctgttggaacgtacgccggtcgcggactttttcgaacggccccggagcccggaggcgcgcgccttcacccggggcgagctggtctggtag

SEQ ID NO: 7090 - DNA, 777 bp, Acidovorax sp. JS42
atgagcgcgctgccgtcacccgtcttccccggggaggagagcccgggcgacgtttccactatcgagccgccgttgtttgcactgcgcgagctgtccgtgcgctacggcgcggtgcaggcgctggccggcatcaatctgcgtgtgatgcccggcgagcgcgtggccctggtgggtgccaacggcagtggcaagagcacgctgctgcgcgcattgcacggcctggtgcgccccagcgcgggacagctgcgtcgcgacggcgcgccgcgcgtggccatggtgttccagcggcctttcgtgttgcgcaccagcgcgctgaacaacgtggcgctgggattgtggctgcgccgggtgcgctggcaggaggcctgcgcccaggccgccgtggcgctgcaccgcgtggggctgcaggacatcgcgcggcagaacgcgcgcaccttgtccggcgggcagcagcagcggctggcgtttgcgcgcgcctgggccctgcgacccgacgtgctgctgctggacgagcccaccgccagcctggacccgcacgccaagcgcgagatcgaggccctgatggccgactttgccgccagccacggcagcgccggcccgcagcagccgctgaccatgctgttcagcagccacaacctgggccaggtcaaacgcctggccagtcgcgtcatttacctggagcacggccgcatcctggccgatctgccggtgcacgactttttcaacggccccctgccggaggccgcccgtctgttcgtcaaaggagaaatagcatga

SEQ ID NO: 7091 - DNA, 717 bp, Methylibium petroleiphilum PM1
atggctgaacaggccttgattgccctggagtcggtgggcctgcgctacggcgcgctcgaggcgctgcgcgccgtgaacctgagcatcgtcccgggggagtgcgtggccttcgtcggggccaacggctcgggcaagagcacgctgctgcgggtgctgcacgggctgctcgcaccgagcgccggcgtgcgccggcagcgcgaggccctcgacggccggccgctgcgcttcgcgatgctgttccagcggcccttcctgttccgcctctccgtccaggccaatgtgcggctgggcctgtggctcggcggggtgcgtggcgaggaggccaaggtgcgcagcgcgcaggccttgcagcgcgtcgggttggccgccgaggcggcgcgtccagcgcgcgcgttgtcgggtggccagcagcagcggctcgcgctggcgcgcgcctgggcgctgcagcccgacgtgctgctgctcgacgagccgaccgccagccttgacccgagtgccaagcgcgaggtcgagaacctgctcgccgagttcgcgatgcagggcatgacgctgttgatggcgtcgcacaacctggggcaggtgaagcggctggcgcagcgcgtcgtgtacctggagcacggccgcgtgctggccgacgtgccggccgcacagtttttcgagggggtggcgctgccgcccgaggccaagttgtttctcaaaggagagttgccatggtga

SEQ ID NO: 7092 - DNA, 723 bp, Sinorhizobium medicae WSM419
gtgcgcgcgcctgcaagcaatcttccccttgtcttcgatgacgtgtcactgagcgccggtgcgacgaccatcctcgaccgaatttgcctgacgatcggcctgggagcgccaacgctcgttcttggccccaacggggcgggcaagacctcgctgttgcggctgtgcatgggtttgctcagcccgacgcggggtgtcgtgagctggggtggccggatcgatggcggtcccgaacgccgagcgatcctgtttcagaagcccgtgatgctgcggcgctcggttgccgcgaatattgcctatggacttgcccacgccggttgcccgcgcggcctgcgtgcccagcgcaccgaggaattgctcgacagtgttggcctgagtgcgctggcttcgaggcctgcgcgccgcttgtcgggcggtgaacagcaaagacttgcgcttgcgcgtgctctggcgcgccagccggaaattctcctgctcgatgaaccgaccgcaagccttgatccggcggcaacgcgcttcgtggaggaaatcatccttgcgacggcccattcgggcaccaagatcatcatggcttcacacgatctgggccaggtgcgcagacttgccggagatgtcgtgtttctggttcatggccgtctcttcgaacatgccgatgccagtgatttcttcgatcgtccagccacgccgcaggctgcagcctttatacgcggcgatctcgtcctttga

SEQ ID NO: 7093 - DNA, 756 bp, Dinoroseobacter shibae DFL 12
atgcgtgacttccacacccatccggagctggagcttggcgacaagcttctcgaagcccgcgacatcgtgctgatgcgcggcggcaagcggctgctcgacggtgtcgacctgtccctgcctgccggtcggcgcacggtgatcatgggggccaatggcgcgggcaagagcctgctgctgcgggtcctgcacgggctcattgcgcccgatgcgggccaggtcctctggcacggcgcccccctgtcggcagaggcgcggcaggcgcaatctatggtgctgcagcgcccggtcctgctgcgacgctcggttctgggcaacctgcgcttcgccctgtcggtccgcggcatccgcggcaaggagcgcgcggcccgcgaggccgaggcgctcgaccgtgcggggctgtccgagtttgcccgccgcccggcgcgggtgctctcggggggcgagcagcaacgtctcgccgtggcgcgggccctgtccaccgcgccccggatgctcctgctcgacgagccgactgccagcctcgatcccgccgccacgcggcagatcgaaagccagatcaacgcggcccatggtgccggggtcactgtcgtgatggtcacccatgatcacggccaggcgaggcggatggcggatgatatcctcttcctgcaccggggccgcgtggccgaggccgggccggcgcagcaggtgctcaccgcgccgcgcagcgccgcggtcgccgcctggctcgacggccggttctacgacggcccctga

SEQ ID NO: 7094 - DNA, 717 bp, Methylobacterium extorquens PA1
atgagcgccgcgcccgccatccatctcgacggcgtcagcctggcgctcggcggacgggtgatcctcgaccgtctcgacatcgaaatcgccgcgcacggcatcaccgcgctgatcggcctcaacggggcaggcaagagcgtgaccctgcgggtgatcgacggcctgttgcggccggatagcggcacggtgcgcctcacgcccggccgccgcgccttcgtgttccagcgtcccgctctggtgcgggcgagtgcggccgccaacgtcgccctcgggctggtcgcgctgaagctgtcccgccgggagcgcgccgagcggatcgcggcggcgctcgcccgtgtcggcctgtcggagcgggccaacgacgcggcgacgcgcttctcgggcggcgagcagcagcgcctcgcgctcgcccgcgcctgggcgatgcagcccgacctcctgcttctcgacgaaccgaccgcgagcctcgatccggccgcgaccgagaccatcgagagcctgatcaccgagatggcgcgggccggcaccaccgtgctcctcgtctcgcacaatctcgggcaggtcgcccggctcgccgacgagaccgtggtgctcgccgccggccgcgccgtggagcggggcccgacccgatccgtcctcttctcaccccgcacacccgaagctcgggcctacctcaccggagaactgccttggaccgccttcgccgcagcttcctga

SEQ ID NO: 7095 - DNA, 711 bp, Methylobacterium radiotolerans JCM 2831
atgagcgcggcgccggccatccgcctcgaggacgtgacgctgtctctcgacgggcgaacggtgctcgaccgtctctgcctggaggtcgtttcgggcagcgtcacggcggtcatcggaccgaacggagcgggcaagagcgtcacgctgagggtcatcgacgggctcctgcgacccgacggcgggacggtccgggtcggcccgcaccggcgggccttcgtgtttcagcggcccgcgctgatccgcgcgaccgcggccgcgaacgtcgcgctggctctcggaagcctgccccgtcctgcgcgcgccgcgcgggtgcaggaggcgctcgcccgggtccgactcgcggagcgcgcacgcgatgccgcgacgcggttctccggcggcgagcagcagcggctggcgctggcccgcgcctgggcggtcggacccgacctgctcctcctcgacgagccgaccgcgaacctcgacccggcttcgaccgagatcgtcgaggggctggtgtccgcgatggcgcgggcgggcaccacggtggtgctcgtctcacacaatctcgggcaggtggcgcgcctcgccgacacggcgatcgtgctggcctccggccgcgccgtcgagcatggtccatcccgccagatcctgttctcgccccgcacgtccgaggcgcgggcctacctcgccggggaattgccgtggaccccttccgtcgtcgcctcctga

SEQ ID NO: 7096 - DNA, 717 bp, Methylobacterium populi BJ001
atgagcgagccccccgccatccatttgcaaaacgtcagtctgacgcgcgatgggcggacgatcctcgatcgtctcgatctcgacgtcgccgcgcaaggcatcaccgcggtgatcggcccgaacggggccggcaagagcgtgacgctgcgcgtgatcgacggtctgatccggccggacgcgggcacggtccgcctgtccccgggccgccgggccttcgtgttccagcgtccggccctgatgcgggcgagtgcccgcgccaacgtcgccctcggcctcgtttccctgaagctgtcgcgccgtgagcgccttgagcgcgtcgacgccgcgctcgcccgggtcggcctcctcgagcgggcggccgatgctgcgacccgattctcgggcggcgagcagcagcgcctcgcgtttgcccgggcctgggcgatgcgacccgacctcctgcttctcgacgagccgaccgcgagcctcgatccggccgcgaccgagaccatcgagggcctgatcaccgagatggccggggccggcaccgccgtgctcctcgtctcgcacaatctcgggcaggtcgcccggctcgccgacgagaccgtggtgctcgccgccggccgcgccgtggagcggggcccgacccgatccctcctcttctcaccccgcaccgtcgaggcgcgggcctatctcaccggagaactgccttggacctccttcgccgcggcttcctga

SEQ ID NO: 7097 - DNA, 732 bp, Methylobacterium sp. 4-46
atgagcccggccctgccgatcctcctcgacggcctgtcgttccgcgccggggggcgcaccatcctcgaccgcgtcagcctgcgcatcgaggagccgggcatcaccgcgctgatcgggccgaacggggcgggcaagagcgtgctgctgcgcctcctcgacgggcttctgcccctgagcgccggcgcggtgcggatcgggccgggcggggcacccgcccggcgcgccttcgtgttccagcggcccggcctcgtgcgggcgagcgccgggcacaacatccgcctcgccctcgcggcggccggctggcgccgggccgaggcgcgggcgcgctgccgcgcggccctcgccctggtcgggctcgcggaccgggcgcgggatccggcgacgcggctctcggggggcgagcagcagcgcctcgccctggcccgcgcctgggcggtggcgccggacctcttgctcctcgacgagcccaccgccaacctcgacccggccgcggccgagcgggtcgagcaggtggtcgccgggatggcgcgggagggcgtgaaggtgctcctcgtctcgcaccatctcgggcaggtggcgcggctcgcccgcgacgtcgtggtcctgtcgggcgggcgggtggcggagcacggcccggtctcgcaagtcctcacccatccccgcgcgcccgagacccgggcctacctcgccggagaattgccgtggaccgccttcgccgcctgttctgcctga

SEQ ID NO: 7098 - DNA, 717 bp, Methylobacterium chloromethanicum CM4
atgagcgccgcgcccgccatccatctcgacggcgtcagcctgacgctcggcggacgggtgatcctcgaccgtctcgacctcgacgtcgccgcgcacggcatcaccgccctgatcggccccaacggggcgggcaagagcgtgaccctgcgtgtgatcgacggcctgttgcggccggatagcggcacggtgcgcctcacgcccggccgccgcgccttcgtgttccagcgtcccgctctggtgcgggcgagtgcggccgccaacgtcgccctcgggctggtcgcgctgaagctgtcccgccgggagcgcgccgagcggatcgcggcggcgctcgcccgcgtcggcctgtcggagcgggccaacgacgcggcgacgcgcttttcgggcggcgagcagcagcgcctcgcgctcgcccgcgcctgggcgatgcggcccgacctcctgctcctcgacgaaccgaccgcgagcctcgatccggccgcgaccgagaccatcgagagcctgattaccgagatggcgcggaccggcaccaccgtgctcctcgtctcgcacaatctcgggcaggtcgcccggctcgccgacgagaccgtggtgctcgccgccggccgcgccgtggagcggggcccgacccgatccgtcctcttctcaccccgcacacccgaagcgcgggcctacctcaccggagaactgccttggaccgccttcgccgcagcttcctga

SEQ ID NO: 7099 - DNA, 735 bp, Methylobacterium nodulans ORS 2060
atgagcccgggccttcccgtcctgctcgacggcgtgtcgttccgggcgggaggccgggcgatcctcgacggcgtgagcctccgcatcgaggagcccgggatcaccgccatcatcgggccgaacggggcgggcaagagcgtgctgctgcggctcctcgacgggctcctcgctccgagccaggggcgcatccgcatcgggcggggggagggcggcgcggtccggcgcgccttcgtgttccagcgcccgggcctgatccgggccagcgccgcccgcaacgtccggctcgccctcggcccggcggggctgccccgcgcggagcaggcggcgcgcatcgcagcggccctcgccctcgtcggtctggccgaccgcgccggcgatccggccaccaagctgtccggcggcgagcagcagcggctcgccctcgcccgcgcctgggcggtggcgcccgaccttctccttctcgacgagccgaccgccaatctcgatcccgccgcgacggaggcggtggagcgggtgatcgccgccatggcgcgggccggcaccaaggtgctgctcgtctcgcaccatctcggccaagtggcgcggctcgcccgcgatgtcgtcgtcctgtcggagggccgcgtggtcgagcacggcccggcccggcaggttctgtccgatccccgttcgcccgagacaagggcctatctcgccggagaattgccgtggaccgccttcgccgcctgctctgcctga

SEQ ID NO: 7100 - DNA, 777 bp, Diaphorobacter TPSY uid29975
atgagcgcgctgccgtcacctgtcttccccggggaggagagcccgggcgacgtttccaccatcgagccgccgttgtttgcactgcgcgagctgtccgtgcgctacggcgcggtgcaggcgctggccggagtcaatctgcgtgtgatgcccggcgagcgcgtggctctggtgggtgccaacggcagtggcaagagcacgctgctgcgcgcattgcacggcctggtgcggcccagcgcgggacagctgcgccgcgacggcgcgccgcgcgtggccatggtgttccagcggcctttcgtgttgcgcaccagcgcgctgaacaacgtggcgctgggattgtggctgcgccgggtgcgctggcaggaggcctgcgcccaggccgccgtggcgctgcaccgcgtggggctgcaggacatcgcgcggcagaacgcgcgcaccttgtccggcgggcagcagcagcggctggcgtttgcgcgcgcctgggccctgcggcccgacgtgctgctgctggacgagcccaccgccagcctggacccgcatgccaagcgcgagatcgaatcgctgatggccgacttcgccgccagccacggcagcgctggccccgatcagccggtgaccatgctgttcagcagccacaacctgggacaggtcaagcgcctggccagccgtgtgctctacctggagcacgggcgcgtgctggcggacctgcccgtgcacgattttttcaacggccccctgcccgaggccgcccgtctgttcgtcaaaggagaaatggcatga

SEQ ID NO: 7101 - DNA, 720 bp, Variovorax paradoxus S110
gtgaacgaacacgcgcagctcgcgagcgcggatgccaccgtctttgcgctctacggcgtcgacgtgcgcctggggcgggtggcggcgctgcacggcgcaaccctgaccatcgcggccggcgagcgcgtggcgctcatcggcgccaacggcagcggcaagaccacgctgctgcggctgctgcacggcctggtgccgcatgcggcggggagcttcaccagcgccgcgccgcgccggcagcaggccatgctgttccagcgcccgcacatgctgcgcgcctcggtgacggtcaatgtggccctggcgctgtggctgcgcggcatgcgctggcgcgatgcccgccgcgccgccattccggcgctggcgcgcgtgggcctggaagacctggccgagcgcaacgcgcgtgcgctgtcgggcggccagcagcagcgggtggcgctggcgcgcgcctgggcgctgcatccggcggtgctgctgctcgacgagcccacggccagcctcgaccccactgccaagcgcgaggtcgagacgctcatcgccgaagccgccgccggccgcacgctggtgttcgcgagccacaacctcgggcaggtgaagcggctcgcgagccgcgtggtctatctcgagcacggccgcgtgctggccgacctgccggtccacgatttcttccatgggcccctgccggaggaggcccgcctgttcgtcaaaggagagttggcatga

SEQ ID NO: 7102 - DNA, 405 bp, Mycobacterium MCS
gtgatgagtctcgaatcgaagccgggcgccgatgcgtcgctcggcgaactgatgagccaactgtccgcccagacgtcgcggctggtgcgcgacgagttgcggttggcgcagaaggaattccaggagtcggccaagcacgccggcatcggagccggattactgagcgtcgcagggcttttcgcagtcctgggattggcgaccgtgatcgcggcggccgtggcggcgctgtcgctggtgctgcccgtctgggcggcggcgctgatcgtcgcgttggtgctgttcgtcatcgcgggcatcgcggcgctcgtcagcaagaaacaggccgatgaagtcacaccggcagcaccgcgcaccgtcgagacggtgaaggccgacatccaagaggtaaaggaccgagcgtcatga

SEQ ID NO: 7103 - DNA, 402 bp, Nocardioides JS614
atgaccgatccgcgtacgacgaccgatgaaccagtcggcgcactcgtgcaccggctctccgagcagatccccgagctggtccgcaccgagctgcggctggcccaggccgagctcgcccagaagggcaagcgcgccggcctcgggatcggcatgttcagcctggccgggctgctggcgttcctcgccaccgccaccctggtcgccaccgccgtgatcgccctcgacctggtgctgccgctgtgggcggcgggcctgatcgtcgccggcgtgctcctgatcggggcgttgggcgccggcctgggtggccgcagcgagatccagcaggcgacgccgcccacgcccgaggtcaccatcgcgaacgtcaaggaggacgtcgccacgctgaagggagagcgccggtga

SEQ ID NO: 7104 - DNA, 405 bp, Mycobacterium KMS; identical to SEQ ID NO: 7102

SEQ ID NO: 7105 - DNA, 405 bp, Mycobacterium vanbaalenii PYR-1
gtgacgcattcgaagacggagccatcgatgggggagttggtgagtcaactctccgagcagacgtcccggcttgtccgcgacgagatgcggttggcgcagaaggagatgcaggagtcggccaagcatgccgggctgggtgcgggaatggtcggcgctgccgcgctgctgtccgtacttggcctggcgacgctgatcgccggcgcggtggcggctctggcgctggcgctgccggtgtggttgtcggcggtgatcgtcgcagtcgtggtgttcgccgctgccggcatcgccgcgctggtcgggaagaagcaggccgaacaggttccaccgccggccgcgcagtccgtggacagcgtcaagtccgacatcgacgagatcaaggtggcacgccatggcagcaggacctga

SEQ ID NO: 7106 - DNA, 405 bp, Mycobacterium JLS
gtgatgagtctcgaatcgaagccgggcgccgatgcgtcgctcggcgaactgatgagccaactgtccgcccagacgtcgcggctggtgcgcgacgagttgcggttggcgcagaaggaattccaggagtcggccaagcacgccggcatcggagccggattactgagcgtcgcagggcttttcgcattcctgggattggcgacagtgatcgcggcggccgtggcggcgctgtcgctggtgctgcccgtctgggcggcggcgctgatcgtcgcgttggtgctgttcgtcatcgcgggcatcgcggcgctcgtcagcaagaaacaggccgatgaagtcacaccggcagcaccgcgcaccgtcgagacggtgaaggccgacatccaagaggtaaaggaccgagcgtcatga

SEQ ID NO: 7107 - DNA, 456 bp, Salinispora tropica CNB-440
atggctgacgtggcgaacgcccgcccaacccaggccgggagcgagccgtccaccgccgaactggtgcagcgggccacggagcaggtttcccggctggtccgcgacgagctgacgctggcccgagcggagttggcccagaaggggaagcacgccggaatcggcatcggcctcttcggtggcgccggggtgctggcactctacgggctcggtgcgctcgcggcgacggtgatcctgctgctcgccctggtcgtgcccgcctgggtggccgccctgatcgtcgcggtggtgctcttcgtcgccgccggggttctcgccctggtcggcaagaagcaggtcactcaggcggtcccgccggtgccggcgggcacggtgcgcagcgtccgggcggatgtcgataccgtcaccgcggcggtgaaggatgggagagccgcggtgcaggacgggagacgggcatga

SEQ ID NO: 7108 - DNA, 456 bp, Salinispora arenicola CNS-205
atggctgacgtggcgaacgtccgcacgacccaggccgggagcgatccgtccaccgccgaactggtgcagcgggccaccgagcaggtctcgcggctggtccgcgacgaactggcgctggcccgggtggagctggcccagaagggcaagcgcgccggaatcggcatcggcctgttcggcggtgccgcggcactggcgctgtacgggctcggtgcgctcgcggcgaccgtgatcctgctgctcgccctgatcatgcccggctgggtggctgccctgatcgtcgcggtggtgctctttgtcgccgccggggttctcgcgctggtcggcaagaagcaggtcggccaggcggtcccgccggtgccggagggcacggtacgcagcgtccgggcagacgtcgacaccgtcgccgccgcggtgaaggatggtagagccgtggcgcgggacgggagacgggtatga

SEQ ID NO: 7109 - DNA, 414 bp, Actinosynnema mirum DSM 43827
atggagcaggtcaccgccgccaccgaccgggcggacccgtccaccggggagctggtcggcaggctgagcgagcaggtgagcaggctcgcccgcgaggagatccggctcgcggtgctggaggtgcaggagaagggcaagaaggccgggcgcggggccgggctgctcggcggcgccggggtgctggcctggttcggcgtgatggcgctggtcgccgcgctgatcctgggattggcgcaggtcatgcccgcctggggcgccgcgctggtggtggcgggcggggtgttcgtggtggccggggcgctggcgctgatcgggcgcgggcagctgcggcgggccgcgccgccgatccccgagcaggccgtggccggggtcaagcgcgacctggccgccgtgagcgagcgggcgcaccggtga

SEQ ID NO: 7110 - DNA, 417 bp, Brachybacterium faecium DSM 4810
atgccgcgaagggagcgtcccgtgtccacttctccatcccctgaagaaacctccatcgcagatctcgtggatcggctctctgcgcagacctcccgactggtgcgcgacgagttgaagctcgcccgcgccgaatacgccgagaaggcgaagcagggcggaaccgccgccggattgttcggtgccggagccgtgctggcctggttcggcgtgggggccctgctggccacgctgatcctcgtgctctcgctggtcctgccggcctgggccgcagcgctgatcgtcacggcggtggtcttcgccgccgccggcatcgccgcgctgctcgggaagaagacgaccgaagggctcaccgccaccccggagcgcacgctcgagaccgtgcgccgggacgccaccgagatcaaggagcggatctga

SEQ ID NO: 7111 - DNA, 408 bp, Catenulispora acidiphila DSM 44928
atgagcatcgacgaccggcgcgagacgcacgccgacgagcacctggcgacgctgctgacgcaagccgcgcaccaattcggacagctggcgcgcgacgaactccagaccgcccgggccgagttcgcccgcaaccgccgcaccctgggcttcggcggcggcctgatcggcggcgcgggcgtgctggcgttcgtcgcggtacaggccgtcgccgccgcggtgatcgccgcgctcgccctggcgatgccggtgtggctggcggcgctgatcgtcggcgtggccgcgggactgacagcggcggtcctggcactggtcggcaagaagcaggtgggacgcgtcgtacccgtagtggaggagaccgtggacagcgtgaaggccgacgtggccgtgatcaaggaaggcggtcggtaa

SEQ ID NO: 7112 - DNA, 414 bp, Saccharomonospora viridis DSM 43017
gtggtgtacgacgaccgacgtgaggccttgcgccagcgctccgtcgcggagctcgtcaacgacctgtccgcgcagacgagcaggctcgtccggaacgagctgtggctggcgcgtgccgagatgcaggccaagggcaagcggttcggcctcggcgcgggtatggccggagcggccggggtcatcgccttgttcgccacgggtgtgctcatcgcggcggccgtgctggctttggccctcgtactcccggcgtgggcggcggcgctcgtggtcggtgtggcgctgctgttgttcgccggagggctggccctgctgggcaggggacaggtgcggagggggtcaccacctgtgccgagggaggccatcgaaagcgtgcgctccgacatcgccgccgtgagggagaagatgcgccaatga

SEQ ID NO: 7113 - DNA, 333 bp, Escherichia coli BL21 (DE3)
atgtacgaagctcttttagtagttttccttattgtggcaattggccttgttggtctgatcatgctgcagcaaggtaaaggcgctgatatgggagcctccttcggagcaggcgcttccgctacgctgtttggttcaagtggttctggtaacttcatgacccgcatgacggcgctgctggcaacgttattcttcatcatcagtctggtgctgggtaacatcaatagcaacaaaaccaataaaggtagcgaatgggaaaatctgagtgcaccggtgaaaaccgaacaaactcaaccagctgctccggctaagccgaccagcgatatcccgaactaa

SEQ ID NO: 7114 - DNA, 279 bp, Baumannia cicadellinicola Homalodisca coagulata
atgtatcatactttgttagtagtctttttcttagttgctattagtttagtagcacttattatattacagcaaggtcctgatgatatagataattcttttggtcttggggcctccaaaactttatttggttctagtggatctagtaactttataacacgtatgactgcatttatggcagccatattctttttactttgtctattattaagtattatttgtaataataaaaaacctgtattaaatagtattaatactactacaaatgtggtaagtgaataa

SEQ ID NO: 7115 - DNA, 324 bp, Psychromonas ingrahamii 37
atgtatgaaatactgttagttgtttatttaattgttgccatcatcttaattggatttgtattgattcaacaaggtaaaggcgctggaatgggagcttcatttggctctggatcttcaaatacagtatttggcgcaagtggtgcgggtaactttatgactcgtacaacggctatactggctattgttttttttggtttaagcctggtattaggtaacctttcaacgaacaaagtgactgcagaccaaaaattctcaaatcttgaagttgaaaaagtgattgatgtccctgttgaaaaagacacatcgggtgatatcccagaataa

SEQ ID NO: 7116 - DNA, 525 bp, Enterobacter sp. 638
ttgccgccttaagattgtccgatatcggtgcttttgctgtttttttccgcagttgatacaatgcactaaaattgcccttgcgaaggccattcgctttggttagtattcacacccgcttcagtgggaaacaaaaatcctgctaaattggtcgaagcattggtatgcggcaaatccgcaaggaacaggttgattatgtacgaagctcttttagttgttttccttattgtagccatcgctctcgtagcgctgatcatgctgcagcaaggtaaaggcgctgatatgggagcctccttcggagcaggcgcttccggtacgctgtttggctcaagtggttcttcgaacttcatgacccgtactacggcgattctggctacactgttcttcattatcagtctggcgcttggcaacatcaatagcaacaagaccagcaaaggaagcgagtgggaaaatctgaatgctccgtctaaaaccgagcagactcaaccagctgaaccggctaagccgaccagcgatatcccgcagtaa

SEQ ID NO: 7117 - DNA, 336 bp, Vibrio cholerae O395
atgtttacagttctacttgtgatttacctgttggcagcggttgctatcattggcctagtgttgattcaacaaggtaaaggcgcagacatgggagcctcattcggtgctggcgcgtcaaacacagtgtttggtgctagcggctcaggtaacttcctaacccgaatgactgcgattttcgcaacagtattttttgttatcagtcttgtgcttggcaatatgtcaactcacaaaactgaatcacaatgggttgacccttcacaaggtcaagtgattcagcaagctggtgactcagtgagtgaagcgcctgctaaaagtagtgacgaaattcctcaataa

SEQ ID NO: 7118 - DNA, 336 bp, Yersinia pseudotuberculosis IP 31758
atgtacgaagctcttctggtatttttcttgctgatttcgattgggctcgtagctcttatcatgttacagcaaggtaaaggtgcggatatgggagcctcattcggagcaggtgcgtctgcaactctgttcggttcgaatggttccggtaactttatgacccgcatgacggctgtattggcgacgctgtttttcgtcattagcttgattttgggaaacatgagctccaaccagggccaaaaaagcagtgagtgggaaaatttaggtcagccactgaaaactgagcagactgcaacgccggtagcaccagtgaaaccgagcagtgatatcccgcaataa

SEQ ID NO: 7119 - DNA, 339 bp, Vibrio harveyi ATCC BAA-1116
atgttttcagttctacttgtgatttacctgttggcggcgcttggtgtgattggccttgtgttgattcaacaaggtaaaggcgcagatatgggagcctcgttcggtgcaggtgcttcaaacacagtgtttggtgcaagcggctcaggtaatttcttaacccgaacaactgctattttagcaaccgtattttttatcgttagcttgctacttggtcgtatgtctacgcacaagactgagtcacaatgggtagacccaacactaggtcaaccagttgtagaacaagttaaagatgcagtaagtgaagttccagcaccaacaggtgatgaaattccacaataa

SEQ ID NO: 7120 - DNA, 333 bp, Escherichia coli HS; identical to SEQ ID NO: 7113

SEQ ID NO: 7121 - DNA, 333 bp, Escherichia coli E24377A; identical to SEQ ID NO: 7113

SEQ ID NO: 7122 - DNA, 336 bp, Serratia proteamaculans 568
atgtacgaagctcttctggtaattttcctgctgatctcaatcgggctggtagctctgattatgctgcagcaaggtaaaggcgctgatatgggagcctcattcggagcaggtgcatctggcacattgttcggttcgagtggttccggcaacttcatgacccgcatgacggctgtgctggcgacgttgttcttcgtcatcagtctgatccttggcaatctgagcaccaaccagaccaagaagggcagcgagtgggaaaatttgggtcagccagtgaaatctgagcagactaccgcgccggcagcaccaaccaagccgagcagcgatatcccgcagtaa

SEQ ID NO: 7123 - DNA, 336 bp, Yersinia pestis Angola; identical to SEQ ID NO: 7118

SEQ ID NO: 7124 - DNA, 333 bp, Escherichia coli C ATCC 8739; identical to SEQ ID NO: 7113

SEQ ID NO: 7125 - DNA, 336 bp, Yersinia pseudotuberculosis YPIII
atgtacgaagctcttctggtatttttcttgctgatttcgattgggctcgtagctcttatcatgttacagcaaggtaaaggtgcggatatgggagcctcattcggagcaggtgcgtctgcaactctgttcggttcgaatggttccggtaactttatgacccgcatgacggctgtattggcgacgctgtttttcgtcattagcttgattttgggaaacatgagctccaaccagggccaaaaaagcagtgagtgggaaaatttaggtcagccactgaaaactgagcagactacaacgccggtagcaccagtgaaaccgagcagtgatatcccgcaataa

SEQ ID NO: 7126 - DNA, 333 bp, Escherichia coli SMS 3 5
atgtacgaagctcttttagtagttttccttattgtggcaattggccttgttggtctgatcatgctgcagcaaggtaaaggcgctgatatgggagcctccttcggagcaggcgcttccgctacgctgtttggttcaagtggttctggtaacttcatgacccgcatgacggcgctgctggcaacgttattcttcatcatcagtctggtgctgggtaacatcaatagcaataaaaccaataaaggtagcgaatgggaaaacctgagtgcgccggcgaaaaccgaacaaactcagtcagctgctccggctaagccgaccagcgatatcccgaactaa

SEQ ID NO: 7127 - DNA, 333 bp, Shigella boydii CDC 3083 94
atgtacgaagctcttttggtagttttccttattgtggcaattggccttgttggtctgatcatgctgcagcaaggtaaaggcgctgatatgggagcctccttcggagcaggcgcttccgctacgctgtttggttcaagtggttctggtaacttcatgacccgcatgacggcgctgctggcaacgttattcttcatcatcagtctggtgctgggtaacatcaatagcaacaaaaccaataaaggtagcgaatgggaaaatctgagtgcaccggcgaaaaccgaacaaactcaaccagctgctccggctaagccgaccagcgatatcccgaactaa

SEQ ID NO: 7128 - DNA, 333 bp, Salmonella enterica serovar Newport SL254
atgtacgaagctcttttagttgttttccttattgtggcaattggccttgtaggtctgatcatgctgcagcaaggtaaaggcgctgatatgggagcctccttcggagcaggcgcttccgctacgctatttggttcaagtggttctggtaacttcatgacccgaatgacggcggtattggcgacgctgttcttcatcatcagtctggtgttgggtaatatcaatagcaacaaaaccaataaaggaagcgagtgggagaatctgagcgcgccggcgaagaccgagcagactcaacctgctgcaccggcccagccgaccagcgatatcccgcgctaa

SEQ ID NO: 7129 - DNA, 333 bp, Salmonella enterica serovar Heidelberg SL476
atgtacgaagctcttttagttgttttccttattgtggcaattggccttgtaggtctgatcatgctgcagcaaggtaaaggcgctgatatgggagcctccttcggagcaggcgcttccgctacgctatttggttcaagtggttctggtaacttcatgacccgaatgacggcggtattggcgacgctgttcttcatcatcagtctggtgttgggtaatatcaatagcaacaaaaccaataaaggaagcgagtgggaaaatctgagcgcgccggcgaagaccgagcagactcaacctgctgcaccggcccagccgaccagcgatatcccgcgctaa

SEQ ID NO: 7130 - DNA, 333 bp, Salmonella enterica serovar Schwarzengrund CVM19633
atgtacgaagctcttttagttgttttccttattgtggcaattggccttgtaggtctgatcatgctgcagcaaggtaaaggcgctgatatgggagcctccttcggagcaggcgcttccgctacgctatttggttcaagtggttctggtaacttcatgacccgaatgacggcggtattggcgacgctgttcttcatcatcagtctggtgttgggtaatatcaatagcaataaaaccaataaaggaagcgagtgggaaaatctgagcgcgccggcgaagaccgagcagactcaacctgctgcaccggcccagccgaccagcgatatcccgcgctaa

SEQ ID NO: 7131 - DNA, 333 bp, Salmonella enterica serovar Agona SL483; identical to SEQ ID NO: 7129

SEQ ID NO: 7132 - DNA, 333 bp, Salmonella enterica serovar Dublin CT 02021853; identical to SEQ ID NO: 7129

SEQ ID NO: 7133 - DNA, 333 bp, Aliivibrio salmonicida LFI1238
atgcatacgattctacttgtgatttatctgattgccgcagtcggtgtaattggcctagtattggtacaacacggtaaaggcgcagatatgggagcctcatttggggctggagcatcaaatacagtatttggctctggtggctctggaaactttttaactcgaatgactgcaatttgtgcaacagtattttttattatcagtttagcattaggcaatatgtctacgcacaaatctgaaggctttgatcttaaattagatcaacaagcaacagagcaagtaactgataatgtgagtgacgttcctgctactgaaaacagcgacgttcctctttaa

SEQ ID NO: 7134 - DNA, 333 bp, Escherichia coli O157 H7 EC4115
atgtacgaagctcttttggtagttttccttattgtggcaattggccttgttggtctgatcatgctacagcaaggtaaaggcgctgatatgggagcctccttcggagcaggcgcttccgctacgctgtttggttcaagtggttctggtaacttcatgacccgcatgacggcgttgctggcaacgttattcttcatcatcagtctggtgctgggtaacatcaatagcaacaagaccaataaaggtagcgaatgggaaaacctgagtgcgccggcgaaaaccgaacaaactcagccagctgctccggctaagccgaccagcgatatcccgaactaa

SEQ ID NO: 7135 - DNA, 390 bp, Azotobacter vinelandii DJ
atgctggaaacagaaacgatcgttatcgtctttcacctgttggctgcgctgggtgtaatcgcgctggtgctgattcagcagggtaagggcgcggaggcgggtgcctctttcggttctggtgcgtcggccactgttttcggtagccagggctcctctaccttcctgagtcgcgttactgctatacttgctaccgctttttttctgaccagccttgggttggggtttctggccaaggagaaggctgactcgctgagcaaggtcggtcttccggatccggcggcgctggaggttcagcagaagaagccggcggcggaggatgtgccggtgcttgaggagcggaaacctgcaggcgatgccgtagacgtgccacaggctcccgagcagaagtaa

SEQ ID NO: 7136 - DNA, 408 bp, Dickeya dadantii Ech703
atggatggccggcggttattccgcaagaatttgaaccagttcgcttttactgcgaaagataatacgggtacagctatgtacgaagctcttttagtcattttccttctggtggcaatcagcctgattggtttgattatgttgcagcaaggtaaaggtgctgacatgggggcgtctttcggagctggggcgtctgcgacgttatttggttcgagcggctccggtaatttcatgacccgaatgactgcactgcttgcgacactgttttttgttatcagccttatcttggggaatctcagttctgggcatagtaaaaaaagcagcgaatgggaaaatctcagccaacctgcaaaggttgagcaggtagttcccgaaaaaccggcaacgccgtcaagtgatattcccaaataa

SEQ ID NO: 7137 - DNA, 336 bp, Dickeya zeae Ech1591
atgtacgaagctcttctggtaattttcctgctggtagcgattggccttgttggtcttatcatgctgcagcaaggtaaaggtgcagatatgggagcgtcgttcggagcaggtgcttccgctacgctgtttggttctagcggatccggcaatttcatgacccgaatgacggcgctgtttgccacgctgtttttcgtactcagcctgattctgggaaatatgagttctgaccacagcaaaaaaggtagtggctgggacaacctgagtcagcctgttgcgcctgaaaaagctgagcagtctaaagcaccagctgcaccgtcaagcgatattcctaaataa

SEQ ID NO: 7138 - DNA, 333 bp, Pectobacterium carotovorum PC1
atgtacgaagctctattagtgattttcctgttagtatcgatcgggctggttgccttgatcatgctgcagcagggtaaaggtgctgatatgggagcgtcgttcggagcaggtgcttctgccactttgttcggttcgagcggctctggtaatttcatgacccgcatgacggcgatactggcgactctgttcttcattatcagcctcgttctgggcaacctgagttcgctgcagaaaaaaggcggcgcctgggataaccttaaccagcctgaaaaagctgagcagacgacaacgcctgctgcgccttcaacgccggcgagtgacattccgaagtaa

SEQ ID NO: 7139 - DNA, 165 bp, Bacillus cereus ATCC 10987
atggctaaaaagaaaagctttccattacgtattgatcctgaattacacgcagtcatcgaaaaatgggcgaatgatgagtttcgtagcgtcaatgcacacatcgagtatttacttcgagaaatggcaaagcaaaaagggaaattgaaaaaagataaagatgtataa

SEQ ID NO: 7140 - DNA, 165 bp, Bacillus anthracis Ames 0581
atggctaaaaagaaaagctttccattacgtattgatcctgaattacatgcagtcatcgaaaaatgggcgaatgatgagtttcgtagcgtcaatgcacacatcgagtatttacttcgagaaatggcaaagcaaaaaggtaaattaaaaaaagataaagatgcataa

SEQ ID NO: 7141 - DNA, 165 bp, Bacillus anthracis str Sterne; identical to SEQ ID NO: 7140

SEQ ID NO: 7142 - DNA, 201 bp, Colwellia psychrerythraea 34H
atggcagccaaaaagagcttcccacttagaattaaccctgaggttttagctgcaatgcagcgatggtctgatgacgaattacgcagtgttaatgctcaaattgaatatgtattaagaaaagccttggttgattcaggccgagtaaagctgattcaaaaagtggtaaccattgttgaagaagctgatgctgttaaaaaataa

SEQ ID NO: 7143 - DNA, 231 bp, Thermobifida fusca YX
gtggcaagcgagcgtaagaaaattctgctccggctcgacccggcggtgtatgacgcgcttgccaaatgggctagtgacgagctgcgcagcacgaacgcgcagatcgagtttcttttacgtcgggcgctcatcgacgcgggccgtatgcctcagggagtcaaagcgatcccccgccggggccgccctcgcaagcaggacacctcaccgcccgcggacgactccccttcctaa

SEQ ID NO: 7144 - DNA, 213 bp, Novosphingobium aromaticivorans DSM 12444
atggcagcgccaccgaagaaggcctttcccctgcgtatcgacccggcgctcttcgctgcggtcgagcgcgcggcggcggccgacctgcgctctgccaatgcccagatcgaggtgctgctgcgcgaagccctgacaaggcgcggcgtgaaacttgcggcggctgagcctgcgcggcgcggtcgtccacccaggaaggagaacggcaatggttga

SEQ ID NO: 7145 - DNA, 198 bp, Deinococcus geothermalis DSM 11300
gtgcctcgcaagcattacccgctgcggatcagtcccgaactgtacgctgccctggagcgctgggctgccgacgaactgcgcagcgtgaacgcccagatcgaatacctcctcacccagagcgtgcgtcaggcggggcgctggaaagcggcgccaaaggcgggggaagaggccagggagagcgagcagcagaaggagtga

SEQ ID NO: 7146 - DNA, 210 bp, Sphingopyxis alaskensis RB2256
atgaccggttctgccaaaaaggcctttgcccttcgccttgatcccgcgctgttcgccgcggtcgagcggatggccgcggccgacctgcgcagcgccaacgccgagatcgaagtgctgctgcgcgaggcgctggcgcggcgcggcgtgccggtcaagccacccgcgccgccgcgccgtggccgtccgccgaagaccgatgcgcaggactga

SEQ ID NO: 7147 - DNA, 213 bp, Shewanella amazonensis SB2B
atgaccaaaaaggcttacccattaaggatcaatgccgatgtcctcgcggccatgcagcgctgggccgatgatgagctgagaagcctgaatgcgcagatggagtatgtgctgcgggaagccctggtgcaaagcggccgggtaaaattggtacaaaaggtggtggtggaagtgcaggaaaacgatgagcctgactctgccgaaaacagggagtaa

SEQ ID NO: 7148 - DNA, 198 bp, Sphingomonas wittichii RW1
atgccggcgaggaaggcctatccgctgcgcatcgaccagccgctgttcgacgcgatcgaacgcgcggcggcgaccgacctgcgcagcgtcaacgccgagatcgaatgcctgctgcgcgaggcgctggcccggcgcgggatcagggtcgccccggccgagaagcgcccgcgcgggcggccggcggtggaacgggattag

SEQ ID NO: 7149 - DNA, 159 bp, Bacillus cereus cytotoxis NVH 391-98
atggcgaaaaagaaaagttttccattacgcattgatcctgaattacacgcaatcattgaaaaatgggcgaatgatgagtttcgtagtgttaatgctcacatcgagtatttacttcgagaaatggcgaaacaaaaaggaaagctcaaaaaagagaaatag

SEQ ID NO: 7150 - DNA, 273 bp, Frankia EAN1pec
gtggccgaacggaagaagatcctgctgcgcctcgacccggccgtccacgacgcgctggcgcgatgggcgtcggacgagctgcgcagcaccaacgcacagatcgagttcctactgcgggccgcgctcgcggaccggggccggctaccgagggaggccggcgcaataccgcgccgcggacgcccacggcgggacaccaccaccggccccgagcccggccccgaggacgccccctcgaccgaggcggtggacgtccgccgcaccccgccaccgtga

SEQ ID NO: 7151 - DNA, 165 bp, Bacillus weihenstephanensis KBAB4
atggccaaaaagaaaagctttccattacgtattgatcctgaattacacgcagtcatcgaaaaatgggcgaatgatgagtttcgtagcgtcaatgcacacatcgagtatttacttcgagaaatggcaaagcaaaaagggaaattaaaaaaagataaagatgcataa

SEQ ID NO: 7152 - DNA, 219 bp, Caulobacter K31
gtggccgcgtccccacccgaggcgccgaagggcggacgccgcgcatttctgatgcgcgtgcgtcccgacgtcctggccgccgtcgaacatctggcggcggctgagctgcgcagcgtcaacgcccaggtcgaaatgctgctgcgcgaggccctgtcacgccgcggcgcgctgcgagtgctggacagcggttcagcttcggaggaacctccgtccccgtaa

SEQ ID NO: 7153 - DNA, 219 bp, Opitutus terrae PB90 1
atgtccgccgatcccaaaaagagctttctcctgcgcatggaccccgagctatggcgcgagctcgaggcgtgggccgcggcggaactgcgcagcgtcaacggccaggtcgagtatctgcttcgcgaagcagtccggcaacgcaagggcacgcctccgcccggaaacgcctccgcggcgtcatcgcccgacatgtcggcggaagaccgtcagcgcggttga

SEQ ID NO: 7154 - DNA, 180 bp, Stenotrophomonas maltophilia R551 3
atgagtgagaagaaagcctatccgctgcgcatcaatgccgaggtcctggccgcggcgcagcgctgggctgatgacgaactgcgcagcctcaacgctcagatcgaatacgtgctgcgcgacgcgctgcgcaaggcaggacgcctgcccaaacccaaggcatcgccggaggacaaggaatga

SEQ ID NO: 7155 - DNA, 282 bp, Alteromonas macleodii  Deep ecotype
ttgtatctaccgcgtcacagtggcgtaccgcagcgtactgcggcgcataaggtttttgttttggcaaagaaaaaagcgtatccacttaggataaatgaaaatgtgcttgccgccatggaacggtgggcagccgacgatttacgcagtgtaaatgcgcaaatagagtatgtgttgaggcaggcattagtcagtcacgggcgagtcaaactcgttgaaaaagttgtcgtagaagtagaagacgtggacacttcaattcactcagatgacagcacacaaaattag

SEQ ID NO: 7156 - DNA, 165 bp, Bacillus cereus AH187; identical to SEQ ID NO: 7139

SEQ ID NO: 7157 - DNA, 165 bp, Bacillus cereus B4264
atggctaaaaagaaaagctttccattacgtattgatcctgaattacacgcagtcatcgaaaaatgggcaaatgatgaatttcgtagcgtcaatgcacacatcgagtatttacttcgagaaatggcaaagcaaaaagggaaattaaaaaaagataaagatgcataa

SEQ ID NO: 7158 - DNA, 165 bp, Bacillus cereus G9842
atggctaaaaagaaaagctttccattacgtattgatcctgaattacacgcagtcatcgaaaaatgggcaaatgatgagtttcgtagcgtcaatgcacacatcgagtatttacttcgagaaatggcaaagcaaaaagggaaattaaaaaaagataaagatgcataa

SEQ ID NO: 7159 - DNA, 165 bp, Bacillus cereus AH820; identical to SEQ ID NO: 7140

SEQ ID NO: 7160 - DNA, 234 bp, Desulfitobacterium hafniense DCB 2
atgagtatgtccaagaaacaattcgctttaaggttagatcccaaactatatacggctctggaaaaatgggcagccgatgagtttcgaagcgtcaactctcatattgagttcctgcttcgagaagctacccgcaagtcgggacgccttaataagggcggggaaacacctggtgaaggaggagattatatagatgttaaccctcatggaagaagttcttctcatttctctgaatga

SEQ ID NO: 7161 - DNA, 186 bp, Clostridium cellulolyticum H10
atggcagaaaaaaagacactgttacttagactaagccccaaactgtgggaagaaatatcgaaatgggcggaagatgaatttcgctcggtaaacggtcaaatagagtatattattagcgaagcacttcgtaaacgaaataaatcagctcacaaaattgtttctgattcggaggatgcgaaagactga

SEQ ID NO: 7162 - DNA, 264 bp, Actinosynnema mirum DSM 43827
gtggccgagcgcaagagcgtcctgctgcgcctggacccggcggtgcacgacgcgctgaccaggtgggcgaacgacgacctgcgcagcacgaacgcgcaaatcgagttcctgctccgccgggcactggccgaggcgggcaggctgcccggcggaacgggcgccccggcccgcaggggccgcccccgcaaggcggcgcggaaggacggcgaaccacaggaacccgatccgacgacacccccggaaccacctccccggaacgagtga

SEQ ID NO: 7163 - DNA, 192 bp, Geobacillus WCH70
atggcaaaaaagaaaagtttccccttgcgaatcgatccagccttatacgaagtcattgagcggtgggcacacgatgaatttcgcagcgtcaatgcacatatcgaatttctattgcgcgaagccgctaaacgagccggacgacttacgcagcgaaaaataaatacagacaaatccaccgatgaaagaggctag

SEQ ID NO: 7164 - DNA, 213 bp, Eggerthella lenta DSM 2243
atggcgaagcgaaaacagtatcccctgcgcatcgattcggaggtgtgggccggcatcgaacggtgggccgccgacgatttgcgcagcgtgaacgcccaggtggagttcatcctgcgccgggcgctcaaggacgcggggcgcctcaaggacgaaggcggccggcagcccgggcatccgggacgcacgggagacgaagaagcgcccgcggagtga

SEQ ID NO: 7165 - DNA, 183 bp, Dyadobacter fermentans DSM 18053
atggcggagaaaaaagcatttgttttgcggatcaatcctgatatgctgcgggagctcgaaacctgggcacagcaggatttccgcagtttgaacgggcagatcgagtttttgctgagcgaagcattgaaaaaacaaaagcgctcaaaatcaaagggaagcggcggcgacggtgcaaaagagtaa

SEQ ID NO: 7166 - DNA, 192 bp, Chitinophaga pinensis DSM 2588
atggcggataagaaaacatttgtattaaggattgatacccaaacatatgaagcaattgagaaatgggctgcggatgagttcagaagtatcaatggtcagctggagtggatcatacaccgtgcactgaaagaagcaggacgtacggttaaaacagggcctgaaaagccgcccaaaaagaatgacccggcataa

SEQ ID NO: 7167 - DNA, 291 bp, Catenulispora acidiphila DSM 44928
gtgagcccgcggaagcagatcctgctgcgcctggacgcgtcggtccacgacgccctcgcgcgctgggccggcgacgagctgcgcagcaccaccgcgcagatcgagtacgtgctgcggcaggctctggcgcaggccgggcggctgcccgacgacgtggggaagatgccgcggcgcgggcggccgccgaagggggcggcggcgggtgaggcagcacacggagatcaggcaggcgatgaagacggccaggcggaccgtgcggaccaggcgagcccgggaccggatcaggagtga

SEQ ID NO: 7168 - DNA, 195 bp, Anaerococcus prevotii DSM 20548
atggccaaaaaacaaatacccctaagggtatcggaaaaactctacaagcaaattgcccaatgggccgaggatgattttagatcaataaacggtcagatagaatacctcctcacagaatgtgtcaaacaaagaaaaaaagacggcaaatatgtctcagaaacgatagatgaaccaatagacttagatattgagtaa

SEQ ID NO: 7169 - DNA, 201 bp, Atopobium parvulum DSM 20469
atggcacctcgcaaacaatatccgcttcgtgtagctccagaaatctgggaggcagttgagcgttgggcacaagatgatatgcgttcaaccaacgctcaggtagaatggattttgcgcgatgccctgaaaagggcaaagcgttctccaaaagctaataacacttgtatgaacaagacagaaaagatggaagaaggaaactaa

SEQ ID NO: 7170 - DNA, 189 bp, Desulfotomaculum acetoxidans DSM 771
gtgccgcctaaaaaaagttttctactcagaatagatccaaaactatatgaagtattggaaaagtggtcagcagatgaatttcgcagtgttaatgcacaaattgaatacattctgcgaaacgcggccggcaaggccggcaggctgccaaaaaaagaaactgctcaaatcctaaatgaagataaaaaatag

SEQ ID NO: 7171 - DNA, 534 bp, Thermobifida fusca YX
atgaccgtcgacggcgcgaagtccgcaccccccaccaaagcagcccgccacgccaagatcaccgaactgctcaccaagtacgctgttcgttcgcagaacgaactggcccggctgctcgctgaggagggggtccaggtcacccaagccacactctcccgggacctggacgaattgggcgcggtcaaactccgcaccgtcgacggcaacctcgtctacgtactccccggggagggcggggaacgccttccccgggcccacgccgacgaacttgagttggagcaggtctccaacccacggttgagccgactagccgaagacctgctggtctcggccgaggcctcggccaatatcgtcgtcgtccgcacaccgccgggggcagcccagtacctggcctcggcaatcgaccacagcgacatccccgccatcctgggcaccatcgcgggagacgacaccatcctggtcgtcgcccgcgacccccaaggcggggaagaactcgcagccacgctgctgcggttcgccaaccggcgcgtctag

SEQ ID NO: 7172 - DNA, 447 bp, Chlorobium chlorochromatii CaD3
atgaacaaacaggcacggcattttaaaattagagagattcttcagcgccatagtgtagaaaaccagcacgatttgttacaacttttacgcgagcaaggtatgagcgttgcccaagccaccctttcgcgcgattgtgcagaacttgggcttatgcgcgttcgcgtaaacggcagctaccgcatggttgttcccgacgataacgctggacgcattattaaaggcttagtaggcattgaggtactttccattaacgccaacgaaaccaccgtgattattcgcacgctaccgggacgtgcgcacggagttggctcatatcttgatcaactcaaaagcccattggtacttggcactattgcgggcgatgacacggtgttggtaattcccgcatcggtgcataacatttcatccctgatagcctatattcacagcaacctttctaaaacctga

SEQ ID NO: 7173 - DNA, 705 bp, Frankia CcI3
atgacctcggaagcaggcgcggaggccgcgcgtgccgcgccgttgaccaagcacgcccgccaggctcggctggcggcgttgatcggtcagcgcggcgtgcgttcacagaccgagctcgcgcgtctgctggccgccgagggcgtccaggttacccaggcaaccctgtcccgtgatctggaggacatcggggcgaccaaggtgcgcggtccggacggcggcttggtctacgcggtcgaggcgaacctcgcgccggcggagatcgtccggttgtcgctcacccggctctgcgaggaactgctggtctccgcggaggccaacggcgacctggtcgtgctgcgcacaccgtcgggcgccgcgcagctgttcgcctcggtgctcgaccgggaggcgcttccgggggtcatgggcacgatcgcgggggatgacacggtgctcgtcgtctgccggtcggctcccgcagccgaggccctggtccgtccggagagctcggtccgtccggagagctcggtccgtccggagagctcggtccgtccggagagctcggtccgtccggagagttcggtcggtccgggagatcccgctggtcagggagggcatgctggtccgaggggtccggcactcgccgctcatctcctgtggctcgccgacggccgggcgcggggagcgtcgacgggatcgtccgccgtgccagaccaggatgcgtag

SEQ ID NO: 7174 - DNA, 555 bp, Acidothermus cellulolyticus 11B
atgaccacggccacgccgggtaccaaggctgcccggcacgcacggatccgggagttgctggccgcccggtcgatccgctcccagcacgaactagcggaactgctggcggccgagggattcttggtcacccaggcgaccctgtcgcgggatctcgaggagatcggtgcggttcgcctccgctccgtggacggcgggttcgtctacgtcgtgccatcgaccgaaccgccggcggcctccgctgcgggccgtctggcccggctggctgccgagctgctgatctccgctgagccgagcggaaaccttgtcgtcgtccggaccccgcccggcggggcgcatctgctcgcttcggcgatggaccaggctgggttacccgacctgctgggcacggtggccggcgacgatacggtgctgtgcgtcgtccgccggccggacgggggcgcggcacttgcccgccgcctccttgacctcgcccaacggcgtggtgcgctgacccgggcccgtaagaggtcggcatccccgcatgccggagctgaacacgaaggagagattcgatga

SEQ ID NO: 7175 - DNA, 486 bp, Mycobacterium gilvum PYR-GCK
gtgacagcggcgaccacccgcgccggccgccaggcgaggatcgtctcgctgctgtcggcccagtcggtgcacagccagaccgaactcgcggcgctgctcgccgacgaggggatcgacgtcacgcaggcgacgttgtcgcgcgatctggaagaactcggcgcggtgaagctgcgcggcgccgacggcggtgtgggcgtgtacgtcgtgccggaggacggcagtccggtgcgcggggtggcgggcggtaccgaacgggtgacgcggcttctcggggacctgctggtgtccaccgacgccagcggtaacctcgccgtgctgcgcaccccgccgggcgccgcgcactacctcgcgagtgccatggatcgggccgcgctgccgtatgtggtcggcacggtggccggagacgacacgatcctggtgatcgcgcgcgagccgatgaccggcgccgaactggccgtcaccatcgagaatctcgccaagacctaa

SEQ ID NO: 7176 - DNA, 519 bp, Salinispora tropica CNB-440
atgaccgccccgctgacccgcgccgcccggcacgcccgcatcgtcgagctgatccgggacaaggcgatccactcgcagaccgagctgggcgacctgttggccggtgacggtatccaggccacccaggcgaccctctcccgggatctcaaggaactcggcgcggtgaccgtacgcggcggtgacggacgcggcgtctatctgatcccagaggacggccagcgtccgttgcgggaggccgagaccgccccggcgcgtctcgtgcgcctgctgcgcgagctgctcaacggggttgacgccagcggcaacatcgctgtgctccgtaccccgcccggcgcggcccagttcctggccagcgcgttggaccgcgcaggcctgcccgaggtcgtcggcacgatcgccggcgacgacaccatcctcgtcgtggcccgcgaggccgacggcggagccgcgctcggcgaccaactcgccggctgggcccgccgcgaagacaacgttgaaaggagcacacaccatgactga

SEQ ID NO: 7177 - DNA, 531 bp, Mycobacterium tuberculosis F11
gtggctgctggagcgctcatgagccgcgccaaggccgcgcccgttgcggggcccgaggtcgccgcaaaccgcgccggccgccaggcgcgcatcgtggcgatcctgtcgtcggcgcaggtgcgcagccaaaacgaactggcggcgctgctggccgccgagggcatcgaggtcacccaagccacactgtcacgcgatctggaagagctcggcgcggtgaaactgcgcggcgcggacggcggcaccggcatctacgtggtgcccgaggacggcagcccggtgcgcggcgtctcgggcggtaccgaccggatggcgcggctgctcggtgagctgctggtgtcgaccgacgacagcggcaacctcgcggtgttgcgcaccccgccgggcgcggcgcactacctggccagcgccatcgaccgcgcggccctgccccaggtcgtcggcaccatcgccggtgatgacaccatcctggtggtggcccgcgagccgacgaccggcgcgcaactggccggcatgttcgagaaccttcggtaa

SEQ ID NO: 7178 - DNA, 570 bp, Frankia EAN1pec
atgaccatccgctcggccgcgccgctgacgaaacacgcccggcaggcccgcctcgccgcgctgatcgcggcgcggtcggtacggtcgcaggcggagctcgcgcgtctgcttgccgaggaaggtgtgcaggtcacccaggccaccctgtcccgcgatctggaggacatcggcgcgacgaaggtccgcggggccaacggtgcgctcgtgtactcggtcgacgtgaacctggcgccggccgagacggtgcgcatcccgctggcccggctctgcgaggagcttctcgtctcggctgaggccaacggcgacctcgtcgtgctgcgtaccccgccgggggccgcgcagctgttcgcctccgcgctcgatcgggcggccctgccggaggtgatgggaaccatcgccggtgacgacaccgtcctggtggtctgccgcgcggggcccaccggccccggtgggccagcgttcgccggccggctgctgtcgctggccgacggcgtcgcacgggtggcggttccacccggaacgggcgggcatcccggcatcggggcaggtaccggcgcgggcgccggctga

SEQ ID NO: 7179 - DNA, 447 bp, Chlorobium phaeobacteroides BS1
atgagcaaacagatccggcatcgcaaaatcaaggaaattctactgagcagcacggtgaccaaccagcatgagctcatcctgcttctggaaaaaagaggtattgatgtcgctcaggcgacgctctcaagagactgctccgagctgggtgtgcttcgttcacgaacagccagcggttatcggcttatgatcccggaagacaatcccggacagatgatcaaggggctggtggaaatggagatccagtccattgaatccaatgaatcttcaatagtgatcaaaacccttccgggcagagcgcacggagtcggttcatttatcgaccatctcaaaaaccccggaattctcggtactatcgctggagacgatactgttcttgttattccgtcttcagttcatgatattcgttccatacttgactacatgcaaacaaatcttttaaacaactga

SEQ ID NO: 7180 - DNA, 555 bp, Beutenbergia cavernae DSM 12333
atgagcaccacgtcaccgccgacgaagaccgcccgtcacgcgctcatcgcgcaggcgatcactcgcgcccacatccactcgcagggcgagctgctcgagacgctcgcggccgacggcgtcgtcgtcacccaggcgacgctgtcccgcgatctcgtggagctgcaggcgcagaaggtgcgcggaccggacgggctggtgtacgcgctgccgccggagggcggggcacacgccctgggacctgcgtcctccgacgcggagcagctgtcccggcggctcgaacgcctctgcgccgagctgctcgtgtccgcggaggcgagtgccaacctcgcggtgctgcggacgccgccgggtgccgcgcagttcttcgcgtcggcgatcgaccactcggtgctccccggcgtgctcggcacgatcgccggcgacgacacggtcctcgtgatctcgcgcgacccggccggcggagccgacgtcgccgaccgcttcctcacacttgccgcgggcgtccagcccgaggccaccactcccaccacctcgcagcaggagagaagttcatga

SEQ ID NO: 7181 - DNA, 429 bp, Eggerthella lenta DSM 2243
atgagaaaacgtcaacaacggcacgacatcattcgcgacatcattcgcgaacataatgtcaagacgcagcgcgatctcgccaatcagctgcaggccgctggctacgaatgcactcaagccacgatctcccgcgacatcatggatatgggcctggtgaagtctcgtgagggctattacgttctccctgaggaaatgcggctccagcgcatggtatccgaattggttgaagaggtgcacgtggcaggcaacatggtcgtagtgaagacgttctccggcggagcagccggcgtctctgctgcgctcgacaaggccagcctgcgcggagcactcggcacggtggccggcgacaacacgatcatgatcgcggcggagagccctgaggctgccgtcgaagtcgagcgcgccatcgaccgactgcgacgacgctag

SEQ ID NO: 7182 - DNA, 516 bp, Saccharomonospora viridis DSM 43017
atgaatcgggcgagacggcacgcccgaatcaccgagctggtgtccagcatggccattcggagccagaccgaactggccaggctactggccgccgaaggtatcgaggtcactcaggcgactctgtcgagggacctcgacgagctcggtgcggtgaagctcaggggcgcggattcgggagccccggtgtacgtgattcccgaggacggcagtcccgtccggggcgtgcagggtggcacagcgcgattgtcgaaactgttggccgaattcatggtctcggccgatgcctcgggcaatctcatggtgttgcgtacccctccgggcgcggcccaattcctggccagcgccatcgacagggcagcgctggacgaagtcgtcggttccatcgccggcgacgacacgatcgcggtgatcgccagggaaccgttgacaggcaaggagttggcggaacggttcaccgcattggcgcaacggtcgtcgaaagcggacacgaacgtgagtgaggagaagaacaaatga

SEQ ID NO: 7183 - DNA, 588 bp, Jonesia denitrificans DSM 20603
gtggttggtgaacaactcatgagctcaacgcttccacccaccaaggctgccaggcatgccaggatcgcccacatcctcacgcatcaagcgatccactcgcaagccgaacttgcgcgcgccttagaagttgacggattgtatgtcactcaagccacactcagccgtgacctcattgagttacgtgcggaaaagattcgcgatgcgcgtggcggcctgatctaccgggtgacaccagaaggtgccgagcaagtacgttcctctcagcgtgaatcggagacagcaatcgcacgacttgcccgactgtgcgctgaactgttgatttctgcgcagtcctcgggtcagcttgtggtcttgcgcaccccacctggtgcagcccaattcctcggctccgcgattgacacctccgctatggatggcgtcatgggaacgatcgccggtgatgacacagtcttggtgatcacccgggaagacaccaatggcacagacattgctcaacgcttcatggtgcttgccggcgacaccacatcagacaaaaacgacgacccccagcgctcttcagcgcacgaaacaggaagtagaacaccatga

SEQ ID NO: 7184 - DNA, 237 bp, Methanosarcina barkeri fusaro
ttgacaaaattcagcctgctcgaccatgagtcggtccctaaacatgaaatcatgcctgaaggcgagttgaagtctgttttaagcaagtattctattgaaaaggagcaacttccgaaaatcaaagtgcatgatcctgtttgcaaagaaattggagctgttgtcggagacgtggtgaaaatcacaagaataagtcaaactgcaggggaggcagaatactacagacttgtgatcgaataa

SEQ ID NO: 7185 - DNA, 252 bp, Methanospirillum hungatei JF-1
gtgtccgccgagctgaacgtactgaaacatgagatggtaccagaacacagtatcatgagcgaagaagatgtaaaaaatctttatgctcgataccagatcggacccgaacaattgccgaagatttatcatgatgatccggcagtattgtcaataggggccagaattagtgacgtaattaaaatcgtccgaaaaagtatgactgccggccgagcagaatcctatcgtctggtagtaagacgacccaaaaaataa

SEQ ID NO: 7186 - DNA, 237 bp, Methanococcoides burtonii DSM 6242
ttgagtaagttcagcctgcttgaccacgaattaatcccccatcatgaaattatggatgaggatgatctgaaaactgttctaacacattataatgttgaaagggagcagttaccgaagttgaaagtaacagatcctatcgcactggaaattggtgcggagcctggtgatgttgtgaaggttattcgcaaaagccagacagcaggtgaagcactttattacagatatgttatagggtga

SEQ ID NO: 7187 - DNA, 237 bp, Methanosaeta thermophila PT
atgaagaggtttgccgtacaggatcacgagctggtaccggaacacatcctcctcactccagaggaggcccagcaggtcctgatgcagtacggtgtagaggcgcgccatctgccgaagatccacgtcacggatccagttgctaaggagattggcgccaaggtaggggatataataaagataaagcgcaagagccccacggcaaaggagtcgatattttacaggctcgttatcgattga

SEQ ID NO: 7188 - DNA, 243 bp, Thermofilum pendens Hrk 5
atgcctaggaagttcgatgttttggagcacgagcttgtgcctaagcacgtgttgctctctaaagaggaggccaacaggctacttaaagctatggggctgaagaagtcagagctaccgtggatatactcgaccgaccctgttgccagggctttgaaggctaagcccggagacgtgataatgattataaggcaaagcccgacagccggagagtctgtggcattcaggctggtgatgcgcggatga

SEQ ID NO: 7189 - DNA, 228 bp, Pyrobaculum islandicum DSM 4184
gtgtcaaaggcctccttaggggtaaaagaagttgtgaaaatccccaaagaagaggctaaagaattacttaaacaacttaggcttaagccctggcaattaccctggataagatcaagtgatccattggcacagtcaataggagctaagccaggcgacgtgttaaaaatagtaagagaatcccccacagcgggcgaatttgtggtatatcgattggtcgtacctgggtaa

SEQ ID NO: 7190 - DNA, 249 bp, Methanocorpusculum labreanum Z
atgacaagactcaatgtattactgcatgagatggtccccgaccatcagatcatgactgacgaagacgtcaaaaatcttctcacaaccttcgacatcacggaagatcaccttccaaaaatctatcatgatgacccggctgtaaaagcctgcggcgcaaaacccggaaacgtcattatgatcgtaagaaagagccagacagcaggcgaagccacatcctaccgccttgtcgttagaaggccgaaaaaataa

SEQ ID NO: 7191 - DNA, 252 bp, Methanoculleus marisnigri JR1
atggggacttcacttgacgtactcaatcatgagatggttccggaccatcagattatgggcgaagaagaggtcgccgaccttcttgcgacgtaccatataactctagagcaattgccgaaaatctaccacgacgatcctgcagtgaaggctatcgggggcgaggtcgggaacgtcatccggatcgttcgcgacagtcgcaccgcgggcagagccgaagcctacaggctcgttgtgaagagaccgaagaaataa

SEQ ID NO: 7192 - DNA, 228 bp, Pyrobaculum calidifontis JCM 11548
gtgtctaaacagacgcttggagtaagagatgtgatactaattccaaaagaggaggccaaggccttaatgaggcaactgaggctaaggccttggcaacttccgtggattagggcaagtgacccacttgcaaaatctgtgggagcaaagccgggggatgtattgaagatcgttcgcgattcgcctaccgcaggcgaggcggtggtttacagactcgtggtgcctgggtaa

SEQ ID NO: 7193 - DNA, 237 bp, Methanococcus maripaludis C5
gtgaaagtatcgtcacatgaaatggttccgacacatgagattattccaagagaagaaataccccttttactcgaaaaatatgatataaaattgcagcaattacctaaattgctcgataccgatcccctcgtgctcgaagttgaagcgacaccaggagacgttttaaaaataacaagaatgagccctactgcaggcgaaactacctattacagattagtaatagcaacttcaccctaa

SEQ ID NO: 7194 - DNA, 228 bp, Pyrobaculum arsenaticum DSM 13514
gtgtctagagtctctcttggggttagagaagtctctgtaatacctaaggaggaggcaaaagaactcctcaaaaggctaaggataaggccatggcaactaccgtggatcaggtcgagcgaccccttagccaagttggtagacgccaagcctggggacgtgttgaaaatagttagggagtctcccaccgctggcgagtttgttgtgtatcgccttgtcgtcccgggctaa

SEQ ID NO: 7195 - DNA, 252 bp, Metallosphaera sedula DSM 5348
atgcgttcatcttctaaaaagatagatccgagtgtgcatgtgcttgttcctaaacatgaagtactctctgttgaggaagcgttcaaggtccttaaggagcttggtattgggcctgagcaacttccttggatgagagcctcagatcctatggcgaggacaatcaatgcaaagccgggagatatagtgaaaataaccaggaaaagtcccatagttggagaacttgtagtttataggtatgtggtgagtggataa

SEQ ID NO: 7196 - DNA, 237 bp, Methanococcus vannielii SB
gtgaaagtatcctcacatgaaatggttccggaacatgaaattatcccaggagacgagattccctttttactcgaaaagtacggtataaaaatacaacaatttccaaagttattgattagtgacccgctggttattgaagtcggtgcaaaagttggagacattgtaaaaataactcgaaagagtcagactgcaggcgaaacagtttactttagattagttgtatccaattcagtttag

SEQ ID NO: 7197 - DNA, 237 bp, Methanococcus aeolicus Nankai-3
gtgaagatagcattaaatcaaatggttcctaagcatgaagttatttcaaaggaagaagttcaaaagttattagcgaaatacgatataaagatacaacagctaccaaaaatatttgatattgaccccgttattgaagaaattggggcaaaacctggcgatgtagttaaaatatcaagagatagcccaacctcgggacatgctacatattataggttagtagtcaaaaagacaatttaa

SEQ ID NO: 7198 - DNA, 237 bp, Methanococcus maripaludis C7
gtgaaagtatcatcacatgcaatggttccgacacatgagattattccaagagaagaaataccccttttactcgaaaaatacaatataaaattgcagcaattgcctaaattgctcgataccgatccacttgtgctcgaagttgaagcagctcctggagacgttttaaaaataacaagaatgagtcctactgcaggcgaaagcacctattacagattagtaatagcaacttcactctaa

SEQ ID NO: 7199 - DNA, 252 bp, Candidatus Methanoregula boonei 6A8
ttgagcaccaaactgaatgtgttgagccacgtaatggtgccggatcaccagctcatgagtgaagaggaggtatctgccctgctctcccgctaccatattactaccgaacaattaccaaaaatctatcacgacgatcctgcagtaaaagcgatcgatgcgaaagtcgacgacgtcatccggatcatccggaagagtcataccgccggcagagccgaggcgtaccgacttgttatcaggagacccaaaaaataa

SEQ ID NO: 7200 - DNA, 237 bp, Methanococcus maripaludis C6
gtgaaagtatcgtcacatgaaatggttccgacacatgagattattccaagagaagaaataccccttttactcgaaaaatacaacataaaattacagcaattgcctaaattgcttgataccgaccctttggtgcttgaaactgaagctacaccaggagacgttttaaaaataacaagaatgagccctactgcaggcgaaagtacctattacagattagtaatagcaacttcactctaa

SEQ ID NO: 7201 - DNA, 252 bp, Nitrosopumilus maritimus SCM1
ttggcaactaagaaaaatcaaattcttgtacctgatcatatctatgttccaaaacatgaaatcatttcaaaaacagaagctgaagaagttttaaaaaaatacaattgtaaaccaaccgaattaccattaatctttgtaaacgatcctgcaattttgggacttggtgtaaaaccaggtgatatgataaagatcacaagaaaaagtccaactgccggtgaaggtctctattatagatacgtggtggaagtatag

SEQ ID NO: 7202 - DNA, 228 bp, Thermoproteus neutrophilus V24Sta
gtgggcggggtttccctcggggtaaaaaacgccgttgttctttccaaggaggaggccagagagctgcttaggaggctgaggctgcggccttggcaactgccttggattaggtcgagcgacccccttgttcagtccataggcgcaaagccgggcgacgtcatcaagatagtgagggagtcgcctacggctggcgagtctgttatctaccgccttgtggttccggggtga

SEQ ID NO: 7203 - DNA, 228 bp, Halorubrum lacusprofundi ATCC 49239
atggtagacgtaagccaacacgaactcgtcccggaccacgtcctactcgaagccgaggaggtcgacgaggttctggcggagtacgatgtgaaacggacgaacctaccgaagatcaaacgcacagatcccgcgctccccgacgaggcagaggtcggcgacgtggtgaagatcgttcgaaactcccgcacgactgaggaagcggtcgtgtaccgattagtcgtctcatga

SEQ ID NO: 7204 - DNA, 228 bp, Halorhabdus utahensis DSM 12940
atggtagatgtaagccaacacgaactcgtcccggagcacaccattctcgacgacggtgaactcgaggaagtgctcggggaatacgacatcaaacggacagatctcccgaagatcaaacgcgcggatccggctttgcctgacgaggcggaggtcggtgacgtcatcaagatcgctcgggattcacgcacaactgacaccgcggtcgtctatcgactcgtcgtggaataa

SEQ ID NO: 7205 - DNA, 252 bp, Candidatus Methanosphaerula palustris E1 9c
atgagcaccaaaattaatgtattagatcatctgatggtccctgatcatcagatcatgagtgaagaggaggttaaagcattactctccagatacaagatcacctatgaccagctgcctagggtgtatcatgacgatccggcggtcaaacagatcggcggaaaagtcggtgaggtcgtcaagatcgtgcgtataagccagacagcaggcacagctgaatcctatcgtcttatcatcagaagaccaaaaaaataa

SEQ ID NO: 7206 - DNA, 228 bp, Halomicrobium mukohataei DSM 12286
atggtagacgtaagccaacacgaactcgttccagaccacagcatcgtcgacgaggacgttctcgacgacgtgctcgaggagtacaacatcaaaaagacggacctgccgaagatcaaacgcaccgacccggccacccccgacgaggccgaggtcggcgacgtgatcaagatcgtccgtaattcgcgaacgaccgatcaggcagtcgtgtatcgactggtggtgtcctga

SEQ ID NO: 7207 - DNA, 561 bp, Dechloromonas aromatica RCB
atgagaacaacaaacacactggccactttgggatgggccgcctggatcgccctggccgcgccactggcctgggccggtgacgggcacgaccatggcgaggcgcctgcttcatccgccggtccagccgcgccgcgttttgcggcaacgtccgaaacctttgaactggtcggcgtcgtcaatggcaagcaactgacgctctatctcgaccgctatgccgacggcagtccggtcaaggatgccaagctcgaactggaactcggtggcgtcaaagtacccgtcgaaccgcatgccgagggggagttcgaggcgacgctggcgcaggaactcaagccgggggtcgtgtcggtcgcggcgaccgtcatcgccggcgaggaaaccgacttgctggctggcgaactcgacgtccacgaagaggcacatgccgaaacaaccgcccacacccatggctggaaggaatacgccctatgggccggtatcgctggcgggaccctctttgttcttgccactttgttgcgccgcctgcgcgcttcccgtaaaccgcatttcggaggtgccgcatga

SEQ ID NO: 7208 - DNA, 561 bp, Acidovorax sp. JS42
atgaagtcttcccactccctggctgcgctctgccttgcatccgtgctgctcggcaacgccctgccggtcatcgccggcgatggccatgaccacggcgacaccgccccggccgccacgggcaccgcgctgccccgctttgcggcggtgtccgagaccttcgagctcgtcggcgtgctcgatggcaagcaggtcacgctctacctcgaccgattcgtcgacaacaccccggtgcgtggcgcgcagatcgaactcgagatcgacgggaccaagttcaaggccgaggcccatggcgacgacgcgtatgaagtggtgctcaaggaagcgcccaagcccggcgtgctgccgatcaccgcgaccgtgaccgctggggcggaggtcgatctgctggccggcgaactcgacttgcacgaggccgcccacaccgacgagcctgcgcatgaactttcatggaaggaggtcggcggatgggcctccggcggcctggccgtccttgccgtgctggtatttggcgggagacgcctgatggccgcccgccaggttcgcgccggaggtgcagcatga

SEQ ID NO: 7209 - DNA, 561 bp, Polaromonas naphthalenivorans CJ2
atgattatttggaaaaaactgaacgtttgcttcctggcaacgttcattgctgcaacatcgttcacggcattggcagatgcaggtcacgatgacggtgcggcgcccattgctgctactggctcagcccagccacgattcaccgccgtgtccgagacctttgaattggtcggcgtactcaacggcaaattgcttaccctttatctggaccgcgctgatgacaacagtccggtcaaggacgccaagctcgagattgaattggcagatataaagctggacgtcaagcctcgtggcgtgggcgagtttgaaacgacgcttgcgcaagaactcaagccgggtgtgactgccatagcggcgaccgtgatcgcgggtcaggagacagatctgcttgccggtgaactggacatccgcgaaggcgctcatgcggatgcttcagcgcgcagtctgccatggaagaagtacggcatctggactgttgccggactgctcgcgctggcgctgcttgtcgggggcctgcgacgctttcgcacgaatcgaatcaaccgggccgggagtacagcatga

SEQ ID NO: 7210 - DNA, 555 bp, Methylibium petroleiphilum PM1
atgaacctcccccacaccctggccgcgctgttcgttgcggccaccttccttggctcgcccgcatgggcgggcgaaggccatgaccacggtgacgctgcccccgcagccgtcggccaggcactgccgcgcttctcggccgtgtccgaaaccttcgaactcgtgggcgtgctcagcggcaagcagatcacgctgtacctggaccgcttcggcgacaacagcccggtgcgcggcgcgcagatcgaactcgagatcggcggcgccaagttcaaggccgagaaacaaggcgaagacgaatacgaggtcgtgctgcccgaggcccccaaggaaggcgtgctccccatcaccgccacagtgaccgccggcaccgaggtcgacctgctggccggtgaactcgacatccatattgaggctcatgccgacgaggctgttcacacgcactcgtggactgagtacgcagcatggggtgccggaggtctggcagcgctggccttgctcgcctggggtgggcgccgggcgatgagtgcgcgcagcgttcgcgccgggggtgcagcatga

SEQ ID NO: 7211 - DNA, 558 bp, Methylibium petroleiphilum PM1
atgacctccacctctctgtgggccgcgctcgccgtcgcggccctcctcgccaccggcgaggccgcccatgccggcgaaggccacgaccacggcagcgaagccccggccccagccggcgtggcgctgccccgtttcgcggccgtctccgagaccttcgaactcgtcggtgttctcaacggccgccagctcacgctctacctcgaccgcacggccgacaaccgcccggtgcgcgacgccgagatcgcgctcgagatcggcggccagcccgtcaaggccgaggcgcacggtgacgccgagtacgaggtcgtgctggccgaggcgcccgcgccgggcgtcctgccgatcaccgcgacggtgaccgccggcgacgagctggacctgctggccggtgaactcgacctccacgcgcccgtgcacgccgaggctgcgaaccctgcacacgcgaccaaggcctacgccgcctggttcgtcggcgccatcgccgtgctggccctgctcggctggggcgcacggcgggtgctgggcgggcgccgtgtccgcaccggagcggccgcatga

SEQ ID NO: 7212 - DNA, 585 bp, Delftia acidovorans SPH-1
atgaatttcaaaaaacactgcatggggtacgttgctgcagccctgtttgcattcgccgatgtcagtctcgcggcccctggtgcccatggtcccaatggcgagcatcttgacgggcccgctactcaggtccagggcagcagcgctccgcgcctggagacacgctccgagtcgttcgaaatggttgggcgtctcagcgttagcgaattctctatgttcatcaatcggtatgagaccaacgagcccgtgctgaatgcgcaggtggaactggagctgggcaacctcaaggccaccgcgccattccatgcagaccaaggggactatgcagtcgctgacgaggccttcctcaaagcgcttgccgcccctggtgagcacgcgatggtcatcatggtcacggcaggcaatgaggcagacctgctcgacggaacgctggttgttctgtcagaaagtgccgaacacggccacggtcaccacatgtcaaacgccatcaaggctgccatcgttgcaggcctggcacttttgttcttgattggctgggcagtcatgcgtcggaaagctaccgccaagaaggctggagtttcccaatga

SEQ ID NO: 7213 - DNA, 624 bp, Leptothrix cholodnii SP 6
atgaagccatccctttctttcgtgcgccaaggcctgctggccttggcgctcgccatctcgtttccgccacttcatgccggcccgggcgcccatggcccgaacggcgaacacctcgactcgccggcaccggcgaccgcccgttcaagcaccagcccccgctttgaaaccaggaccgaggccttcgagatggtcgggcggctggagggtggtgaactgacgctgttcatcaaccgcttcgagaccaacgagccggtgctggacgcccaggtcgaactcgagtccggcgcactcaaggtgaaagcaccgttcctggccgaccacggcacctactcggtggccgatgccgccttcctcaaggccctggccgagccgggccaacacccgctggtcatcaccgtggtggccggcaacgacgccgacctgctggaggcgacgctgaccggtgccggagcaacagccgtggcggtggccgaccgcggtcacgatgacccgcacggacaggcggcaaccccgtggcgctcggtgaccatcgggctgggagccgtggccgccgtggccgcaatcgggtggttcgccatccgtcgccgcagcgccggcaagacgtcgatgggagcctcgctgtga

SEQ ID NO: 7214 - DNA, 564 bp, Thauera sp. MZ1T
atgaaagcttcccttaccctggcggcgtggagccttgccgccgtccttgcgggcgtcacgccccaggccctggccggcgaaggccacgaccacggcgacgccccggcgcccgtggcgggcccggcgctgccgcgattcaccgccgtttcggagctctttgagctggtgggcgtggtcgatggcaagcacatcacactctatctcgaccgcttcaccgacaacagcccggtcaaggacgcgacgctggagctgcaactcgacggcaacgcgatccccctcgaaacccatgccgacggcgaattcgaagccacgttgcaggacgcactcaagcccggggtcgtgtccgtgacggccacggtcgtcgccggacaagacgcggaccttcttgcgggcgagctggatctgcatgaacaagccgccgaggtgcacgacgaatcggccgggccaagcttgcaatcttacgcaggatggctcggcgccggcgttctcgtgatcggactggtcggctgggccgcgctgcgcaagggaaacgcccgcaaccgttcggccggaggtgtcgcatga

SEQ ID NO: 7215 - DNA, 552 bp, Diaphorobacter TPSY uid29975
atgtcgcaatcctctttctggcgtgcagctgccttgtccagcctcctgcttggcagtagcgcaacgtgggccggcgacggccatgaccatggcgaagccgctcctgcccccgcagcggccgcgcttccgcgctttgccgcagtttccgatgacttcgaactggtgggtgtgctgaacggccagcgtctcacactctacctcgaccatgctgccgacaaccggccggtgaccgatggcgagctgaccctcgagctgggtggtcaacaggtaaaggtcagctcacacggggttggagagttcgaggccgatctgactgagccgctatccgatggcgagacctcaatcatggccactattactgcgcagggccaatcggacctgttgacgggcgttctcgatgttcatagcgaagacgccgaacacgagcatgccgtcgcatccggccgtgtggtcgtactaggtggcggtgccgcagtcctcggcgtcggtgtcctagcgtgggcgctgcgcagacgtacacgcaccaacggtgcactgcgaggtgcagcatga

SEQ ID NO: 7216 - DNA, 543 bp, Azotobacter vinelandii DJ
atgaacctttttccaagaccgaccgcctgcgccatggcggttctgcttttcgccgcggcaccgggcgttccggcggacgacggccatgaccacggcgaggcgcccgccacgcgaacgggaccggccctgccgcgcttcgccgcggtttccgagcatttcgagctggtcggcgtgctcgacgacgggcatctcgccctctatctcgaccgggccgacgacaacagcccggtgaccggtgccacgctcgaactgagcgtcggtggcatcgccatcgccgtcgaggagcacgcccctggcgagttcgagggcagcctggcagccgaactcgaagagggcgaactggccgtggtcgccacggtcgccgtcggccaagtgcgcgagcggctgaccggcgagctggatatccaccatgacgagcatgccgacgagcacgaccacggcatttcccagggcctctacggcgccgccgccggagcggcgcttctgctcgtattgctgggctgggcagtgcgccgcgcccgtaccgcttcccgtcttgtgtga

SEQ ID NO: 7217 - DNA, 465 bp, Thermobifida fusca YX
atggcgtgcagtgcctgccggagagcggaacccttccctcctacacggtgtagtactaccaacagtaaactgacttctatgaagaccaggctcggcgaccttgaacgcgcggtgatggatgtactgtgggaacaaaccgagcccatgacggttcgggaagtaggtcgtgctcttgcagaccgcgacctcgcccacaccacggtcatgaccgtgcttgaccggctcgccaaaaaaggagtcgtacgtcggcaccgcgacggacgtgcgtggcggtatcgcccggcagccagccgagagacctacatctcggagctgatgcttgacgcgctcggccagactggtgaccgcgatgccgctttggcggccttcgtccgctcgatgagcgggcaggaagccgaagtgctccgccgcctcctcttggagaaccacggggagcacggggagagcgacagatcaaggatgtag

SEQ ID NO: 7218 - DNA, 558 bp, Frankia CcI3
atggcgcgcctgggtgacctcgaacggtcggtcatggacgtgttgtgggcgagcgacgactggctgaccgcccgcgaggtcgccggccgtctccagcatgaacgcgatctcgcgtacaccaccgtgctgaccgtgctcgaacggttggaacggaagggattcgtgcggcgtcagcgttcggcgcgcgcgcatcgctacgcggccagcgacagtcgcgaggccgtcgtggccgaggcgatgatggaggcgctcggcacggcggacgatcgtggttccgccctggtccgcttcgtggggtcggtgtccgcggaggaggccgagatccttcgccgtgccctggaacccgtcggttccggggcacccggcatcttcgtgcctggcgccgaggccccgcgcgccgaggatccgcaggccgaggatccgcacacggaggtccggcacgccgaggcccggcgcggtccggcgatcggagacccgccccgcgacgacccggagcagatcgtcacggtagccaccgacccggatcgaacggcccagattccgcccgaccaccggtag

SEQ ID NO: 7219 - DNA, 417 bp, Mycobacterium MCS
atggccaagttgacacgtctgggcgagctcgagcgcgaggtgatggaccacctctggtcggcccgcgaaccccagaccgtgcgccaggtgcacgaagcgctcgccgctcgccgcgacctggcctacaccacgatcatgacggtgctgcagcgactggcgaagaagaacctggtggtgcagcaccgtgacgaccgtgctcaccggtatgcccccacccacggtcgcgacgagctggtcgccgggctgatggtggacgccctcgaccaggccgccgactccggcagccgggaggccgcgctggtgcatttcgtcgagcgcgtcggcgccgacgaggccgccgccctgcgccgggcgctggccgagttggagggcaagcaaggtctcaccaagcccgctggcggtccgggcaccgcctga

SEQ ID NO: 7220 - DNA, 387 bp, Arthrobacter FB24
atggcaagtcttggtgaactggaacgggcagtgatggatctgctctgggcaggtcaggaagcggccaccgcgaacaccctgagggacctgctggcgcagagcacccaggcccagggcggcaccgccggccacgaaggcaaggacctcgccgtgaccacggtcctgactgtgctgtcacgcctggagaagaaggggcttgtggaacgcgaacgcggcacacgtccccaccgctatcaggccgtgtccagccgggcggaccacaccgccgaactcatgcatgaggttctgggatcggcgccggaccgcgaagctgtcctcgcccgctttattgggtccgtcaccgaaagtgaagccgaaacgctgcgcaaactgcttggccacatctaa

SEQ ID NO: 7221 - DNA, 417 bp, Mycobacterium KMS; identical to SEQ ID NO: 7219

SEQ ID NO: 7222 - DNA, 417 bp, Mycobacterium vanbaalenii PYR-1
atggccaagctgacgaggctcggggaactcgagcgttccgtcatggaccacctgtggtccgcaggcgagccgcaaaccgtgcgccaggtgcatgaagccctggccgcccaccgcgatctcgcctacacgacgatcatgaccgtgctgcagcgcctcgcgaagaagaacctggtggtgcagcaccgcgacgaccgcgcgcaccgatacgcgccgacccacggccgcgacgaactcgtcgcggggctgatggtggatgcgctcgaccaggccgccgattcgggtagccgggaggccgcactcgtgcatttcgtcgagcgggtcggggcagatgaggcggctgcattgcgccgcgcgctcgccgagctcgaagacaagcaccgcaccggaggaccggctggcgatccgggtaccgcctga

SEQ ID NO: 7223 - DNA, 417 bp, Mycobacterium JLS; identical to SEQ ID NO: 7219

SEQ ID NO: 7224 - DNA, 417 bp, Mycobacterium gilvum PYR-GCK
atggccaagctgactcgactcggggagctcgagcgctccgtgatggaccacctgtggtcgtccggggagcctcagaccgtgcgccaggtgcacgaagcgctctccgcacgccgcgacctcgcctacacgacgatcatgaccgtgctgcagcgactggcgaagaagaacctggtggtccagcatcgcgacgaccgggcccatcggtacgcacccacccacggacgcgacgaactggtcgccggcctgatggtggacgccctcgaccaggccgcggattcgggcagccgggaggccgccctcgtgcacttcgtcgaacgcgtcggcgccggtgaggcggccgcattgcgccgcgccctggccgaactggaagacaagcacccgacagaccggcccgctggcgattcacccaccgcctga

SEQ ID NO: 7225 - DNA, 435 bp, Salinispora tropica CNB-440
gtgacccggctcggcgagctcgaacgcgcagtgatggatgtgttgtgggacctgttccccggcagatcagacgggctcatggtgcgggaggtcgtcgatgccctcgccggacgcgagctggcctacaccaccgtgctgaccgtgttggaccggctctccggcaagggcatggtgctacgggaacgcgaggggcgggcctggcggtaccgggccgccgcaagccgggaggcgcacatcgcccaactcatgctcgacgcgctggacctcggcggtagtcgagacgccgccctggtgcgcttcgcccgatcggtgacgggcaccgaggcggaggtgctgcgcgccgcgctgaacgcggcgggcgagcccagcgcgccggccagccccgccacaccggccacccccgtcacaccggctgccaaggcgccggagcgctag

SEQ ID NO: 7226 - DNA, 417 bp, Mycobacterium tuberculosis F11
atggccaagctgacacggttgggggatttggaacgcgcggtcatggaccatttgtggtccaggacggaaccccaaaccgttcgccaagtccacgaagcgttgtcggcgcgccgcgaccttgcctacacgacggtgatgaccgtgctgcaacggttggcaaagaagaacctcgtgctgcagatccgcgacgatcgagcccaccgctacgctcccgtgcacggccgcgacgaattggtcgccgggctgatggtcgatgcattggctcaggccgaggactccggcagcaggcaagccgcgctggtgcacttcgtcgagcgagtcggtgccgacgaggcggatgcgctacgacgtgcgctcgccgaattggaagccggtcatggcaatcggccaccggctggcgcggcaacggagacctga

SEQ ID NO: 7227 - DNA, 549 bp, Frankia EAN1pec
atggcacgcctgggtgacctggaacggtctgtcatggacgtcctgtggtcggccgacgactggctgacagcacgcgacgtggcggcccgcctgcaccacgagcgcgacctcgcctacaccaccgtgctgacggtgctggagcggctggagcgcaagggcttcgtccggcgccagcgggccgcccgcgcccaccgctacgcggcgaccgacagccgcgagaccgtcgtcgccgaggcgatgctggaggccctgggcaccgccgacgaccggggttccgcgctcgtccgcttcgtcggctcggtctccgcggaggaggccgagatcctgcgccgcgcgctggagccggccgtgcccgccgaagcgagcgacccaggcgacccgagcgcctcggcggactctgcggactcggcgaagaccaccgtcggggggccggaggacgtcaccgacgtcaccgacggcgccgtgacgaccactccggccagcacatccggagaatcacggatcgcgaccgaggcgcgaccggtacaactcccggcggacgagcggtag

SEQ ID NO: 7228 - DNA, 480 bp, Salinispora arenicola CNS-205
gtgacccggctcggtgacctcgaacgtgcggtgatggacgtgctgtgggacacgccctccgggacgtcggagggcgtcacggtacgggaggtcgtcgacgccctcgccggacgtgagctggcgtacaccaccgtgctgaccgtgcttgaccggctcgccggcaagagcatggtgcggcgggagcgcgaggggcgggcctggcggtaccgggcggctgcgagccgggaggcgcacatcgcccagctcatgctcgacgcgctggacctcggcggcagccgcgacgctgccctggtgcgtttcgcccggtcggtgacgggcaccgaggcggaggtcctgcgtgctgccctgagtgcgaccagcgagtccgtcccgcccgccggccccaccaggccgaccgagaccacccccgaggctgcgcagcccgacgtgacggaccgggccacatgggcacgtctggccggcggggcgacggaccgatag

SEQ ID NO: 7229 - DNA, 384 bp, Arthrobacter chlorophenolicus A6
atggctagtcttggtgaactggaacgggcagtgatggacctgctctgggcgggccaggaagcagccacggccaacactctgcgggaccagctggcccgcacgtccgccgcgcagggcggccccggccacgagggcaaggaactcgctgttaccactgtgctgacggtgctgtcgcggctggaaaagaagggccttgtggagcgggaacgcggaacccgtccgcaccgctaccaggccgtctccagccgggcggaccacacggccgaactcatgcatgaggtgctggggtcggctccggaccgcgaagccgtcctggcccggttcatcggatccgtctccgaaggtgaagccgaaacgctgcgtaaactgctgggtcacgtctag

SEQ ID NO: 7230 - DNA, 396 bp, Kytococcus sedentarius DSM 20547
atgccgaacaccgcatccggactgggtgacctcgagcaggccatcatgaaccacctgtgggacacccccgcgccgcaggcggacggcttcaccgtgcgcgacgtgcacgagaccctcggcgccgaccgggacatcgcctacaccacggtgatgacggtgatggaccgcctctcgcgcaaggagtttctcacgcgcaccaagcaggggcgggcctacgtctaccgggccgcgacctcccgcgaggacttcgtcgcccggctgatgcgggagaccctcggcgacctgcgccccaccgaccgccgtgccgccgtgctcgcgttcgtggacgacgccggcgccgacgacgtggccgccctgcgcgaggcgttggaccgcctcgagagccccacccgctga

SEQ ID NO: 7231 - DNA, 390 bp, Catenulispora acidiphila DSM 44928
atggcgaacgagcgcgcaggcggccccccgaggttgggcgaactggagcgcgcggtgatggacgtcctgtggaacgcccccgacggaagcaccgcgcaagagatcgtcgaacgcctggcggcgcgcgacggcacggcggagctggcggccacgacggtgctgacggtgctggatcgcttgcgccgcaaggacttcgtcgagcgcgagcgtgtcggccgggcgcatcgctatcgggcggcgcggacgcgggacgacgtcatcgccgcctcgatgctcgccgtcctggagacgacggacgaccggcgctcggcgctggtgcgcttcgcgggatcggtgtcggccgaggaggccgcgctgctgcgggaggcgctggccgggctggaggagtag

SEQ ID NO: 7232 - DNA, 384 bp, Saccharomonospora viridis DSM 43017
gtggatgtggctaggctcggagaactggagcgcgcggtgatggaggtgctctgggcgcgcgacgaacccgtcagtgtgcgcgcggtacatgccgctctgggtgatcgcgggctcgcctacaccaccgtgatgacagtgctgacccggttggcgggcaaaggactggtccggcgcagccgggagggtcgggcgtggttgtaccggcccgcggcggcgcgtgaggcgtacgtcgcggagctgatgctcgaggccctggagctcagcggggaccgcggttcggcgctggtgcacttcgcgaagtcggtgaccagcgacgaggccgacgcgctgcgacaggcgctgcagcagggtcatcagccggagcaacagggtaagcagacgtga

SEQ ID NO: 7233 - DNA, 351 bp, Nakamurella multipartita DSM 44233
atggccggcagaggcgagctggaacgggccgtcgtcgacgtgctctgggacgccggtgagccgatgaccgcccgggccgtcgtcgaggcgttgcccggtcgcgaactcgcggtcaccaccgtgctcaccgtgctgtcccggctggagaccaagggtctggtccgccggtcccgggacggccgggcccattcgtacgaggcgaccgcgggccgggaggagcacctggccaccctgatgcggcaggtgctggacggggctccggatcgggatgcggcactgaccaggttcgtcggcgggatctccgaacaggaccaggaagcgttgcggcgcgccctcgacggcccctgctga

SEQ ID NO: 7234 - DNA, 366 bp, Synechococcus sp. CC9605
atgagtccccgcaagacctacatcctcaagctctacgtggcgggcaacacgcccaattcgatgcgggcgctgaaaacgctgcgcaacatcctcgaaaccgaattccggggggtgtatgccctcaaggtgattgacgtgctcaaaaatccgcaactggcggaggaagacaagatcctggcaacgccaacgttgtccaagattcttccaccgccggtgcggcgcatcatcggtgacctctccgatcgcgagcgggtgctgatcggcctggatctgctctacgacgagctgtccgatacgtcgctcaattcgagtttgatcgatgcggtcgatgaggagaccgacacgaccatttcttcagatccttaa

SEQ ID NO: 7235 - DNA, 309 bp, Rhodospirillum rubrum ATCC 11170
atgggtccaaccgttcacctcacgctttatatctgcggcgaaaccctgcgttcgcgcaacgccctgcgggcgatcgaccgcatccgccacgcctacggcccccattgcgccatcaaggtggtcgatgtgatcgacagtcccgccgaagccgaggagcagcggatccttgccacgccgacccttgtgcgcgacctgccccctccgcgacgacgggtcgttggtgatctgatcgatgtggaccaggtgtgccgcatccttgatctccccctcccgccgtcgtgcctcgagaacgcggacataacgccatga

SEQ ID NO: 7236 - DNA, 327 bp, Prochlorococcus marinus MIT 9515
atggcggcaagaaaaacttatattctaaaactttacgtagcaggtaatactcctaattcaatgagagctctaaatactcttaaagaaattctagaaaatgaatttaaaggagtttatgctttaaaagtaatagatgtccttaaacaaccacaacttgcagaagaagataaaattttggctactccaactcttgccaagattttacctccgcctgttagaagaataattggtgatctgtcagatagagaaaaggttttaataggtttagatttactttttgatgaattatcagagagtgaattgaatgggggtaaaaaaaataaataa

SEQ ID NO: 7237 - DNA, 318 bp, Prochlorococcus marinus MIT 9301
atggctgcaaggaaaacatatattttaaaactctatgttgctggaaatactcctaattcgatgagagctttaaataccttaagagaaattttagaaaatgaatttaaaggagtttatgctttgaaggttattgatgtacttaagcaaccacaacttgcagaagaagacaagattttagccaccccaaccttagctaaaattttaccgccaccagtgagaaaaataataggtgatctttcagatagagagaaagttttaattggtttagatttactttttgatgaattaactgaaactgaatatagtggaaataaataa

SEQ ID NO: 7238 - DNA, 306 bp, Roseiflexus sp. RS-1
atgacgagtaaatttgtcctcaagctctacgtcaccggtcagacgccgcgcaccgagcgggcgatccagaacctgcgacgaatctgcgagcagaatcttggcagtcagtatcagttgttcgtgattgacgtgctggaacaaccgcacctcgccgagcaagagcggatcctggcgacgccgacgctgatcaaggaactgccgccgccagtccggcgcattattggtgatctttccgatacgctcaaagtgctgcaaggtttggatctgccagtccatccctcgagcacaggaggaacgcaggagtga

SEQ ID NO: 7239 - DNA, 402 bp, Candidatus Methanoregula boonei 6A8
gtgaaaaaattgtccggaaccgggaagagtgccccgaaccatactgtaaaacaaggtgaaatgttgccaactacaccagatatcaaccggaaggagacagaaacagagatagatgagacagcggacggaagatggatcctgcggttgtacgttgcagggcagacacaaaattccctgaccgcttttgaaaatctcaagaagatctgcgaggattatctcggaggcaagtatacgatcgaggtcatcgatctcataaaagatccgcagctcgcaaaggatcaccagattatcgccgttcccacccttatccggaagctcccggtcccggtcaagaaaatcatcgggaacctctccaacaccgaaaaagttcttgtcggtctggaccttcggaaggtgagataa

SEQ ID NO: 7240 - DNA, 306 bp, Roseiflexus castenholzii DSM 13941
atgacgagcaagttcgttctcaagctctatgtcaccggacagacgccgcgcacggagcgggcgatccagaacctgcgacgcatctgtgagcagaacctgggcagtcagtatcagttgttcgtgatcgatgtgctggagcagccgcacctggcggaacaggaacggattctggcgacgccgacgctgatcaaggaattgccgccgccggttcgacgcatcattggtgatctgtcggatacgctcaaagtgttgcaagggttggacctgccggtccatcccatgggcacaggaggaacgcaggagtga

SEQ ID NO: 7241 - DNA, 582 bp, Shewanella sp. ANA-3
atgtccaccatgttaattgccgttatcttactgaccctattggcattgttctttggggtattactcggatttgctgccttaaaatttaaggttgaaggcaatcccattgtcgatgaactcgaagcgattctgccacaaacccaatgcggtcaatgtggttatcccggttgccgcccctacgccgaagccattgctaatggcgataaagtcaacaagtgtcctcccggcggcactgcaaccatggaaaagctcgccaacttaatgggtgtcgagccagagccgctcaatgccgaggctcagtcccaagtcaaaaaagtcgcctacattcgcgaagatgagtgtatcggctgcactaagtgtattcaggcctgtcctgtcgacgccattattggtgcgggcaaactcatgcataccgtgctcacggcagactgcacaggttgcgatctctgtgtcgagccctgccccgttgactgtatcgatatgatccctgtgggccaaaatctgaaaaactggaactggcgcttaaatgccattcccgtgactcttatccaagagaccccgcacgaagaaaagagaggataa

SEQ ID NO: 7242 - DNA, 663 bp, Verminephrobacter eiseniae EF01-2
ttgagccagccgccagccgccgacgccttggccgatctggcggcgcggatcgacgccgcgctgccccagacgcaatgcacgcgctgcggctatcccgactgccgcgcctatgcgcaggccattgccgagggcgcggccgcgatcaaccaatgcccgcccggcggggccgagggggtggcgcgcctggccgcgatcaccggccagacagcgctggcgctgaatgcccggcatgggagcgaggggccgcgctcggtggcgttcatcgatgaggactggtgcatcggctgcacgctgtgcctgaaggtctgccccaccgacgccatcgtcggcgccagcaagatgatgcacaccatcatcgaacgctactgcaccgggtgtgaactgtgcctgcccgtgtgccccgtggactgcatcgcgctggacaccgccagcggcgccaccaccggctgggccgcctggtccgcagcgcaggcacagcaggcgcgccagcgctatcgacggcatcgccagcgcatgccgggcgaagacccgttggcgcagcgcagcgcagcagccggcagcgccacggaacaggcagaccaggcagcagaccaagcgcgccaggcgcgcatcgcagccgccctggaacgcgcgcgccagcgccggcaggcaggcccgcactga

SEQ ID NO: 7243 - DNA, 615 bp, Shewanella baltica OS185
atgtccggaattttaattgcagtcatattgttgaccctattggcattagtctttggggtattgctcggttttgccgcccttaaattcaaggtcgaaggcaatccgattgtcgatgagctagaagcaattctgccacaaacccaatgcggtcaatgcggttacccaggttgtcgcccctatgctgaagccattgccaatggcgataaagtcaataaatgcccccctggcggcacggccactatggaaaagctggcgaccctaatgggcgtcgagccagagccactgaatgccgaagcacaatctcaagtaaaaaaagtcgcctacattcgcgaagatgaatgtattggctgcactaaatgtattcaagcctgccctgtggatgcgattatcggtgcaggaaagctcatgcataccgtgcttacaaccgactgcacgggctgcgatctctgcgttgagccttgtcctgtcgattgtattgatatgatccctgtcaccccaaatcttaaaaattggaactggcgcttaaatgctatcccagtgacgctcatccaagaaaacagtattcaagaaaccaatattcaagagacaaagtctgaagaggaaaagcggtgttaa

SEQ ID NO: 7244 - DNA, 594 bp, Vibrio harveyi ATCC BAA-1116
atgagtacgattttaattgcgatcatcgctcttgctgccctcgccgcggttttcggagcgatactcggttttgcatcgattcgcttcaaagtagaagcggatccaattgtcgatcaaatcgactctattctaccgcaaactcagtgtggtcagtgcggctaccctggttgtcgtccatacgcagaagcgattgctaacggcgatcaaatcaacaagtgtcccccaggtggtcaagcgaccattgaaaaactggcggatctaatgggcgttgaagccgaagagtcggcacacgatctcgacagcaaagtcaaaaccgttgctttcatccatgaagacatgtgtatcggttgtaccaagtgtatccaagcgtgtcctgtggatgcgattgttggaggtactaaagcccttcataccgtaatcaaagacgagtgtacgggttgtgacttgtgcgttgcgccttgtccaactgactgtattgaaatgattcctgtggaaaccaccacagagagctggaaatggaagcttaatgccattccagtggttaacattacggatgctgccaatgcagcgaacgtgactgattcaattaaataa

SEQ ID NO: 7245 - DNA, 615 bp, Shewanella baltica OS195
atgtccggaattttaattgcagtcatattgttgaccctattggcattagtctttggggtattgctcggttttgccgcccttaaattcaaggtcgaaggcaatccgattgtcgatgagctagaagcaattctgccacaaacccaatgcggtcaatgcggttacccaggttgtcgcccctatgctgaagccattgccaatggcgataaagtcaataaatgcccccctggcggcacggccaccatggaaaagctggcgaccctaatgggcgtcgagccagagccactgaatgccgaagcacaatctcaagtaaaaaaagtcgcctacattcgcgaagatgaatgtattggctgcactaaatgtattcaagcctgccctgtggatgcgattatcggtgcaggaaagctcatgcataccgtgcttacaaccgactgcacgggctgcgatctctgcgttgagccttgtcctgtcgattgtattgatatgatcccagtcaccccaaatcttaaaaattggaactggcgcttaaatgctatcccagtgacgctcatccaagaaaacagtattcaagaaaccaatattcaagagacaaagtctgaagaggaaaagcggtgttaa

SEQ ID NO: 7246 - DNA, 579 bp, Salmonella enterica serovar Heidelberg SL476
atgaatactatctggattgccgttggcgccctgacccttctgggtctggtgttcggcgccattctgggttatgcctcccgccgattcgcggttgaagatgatccggttgttgaaaaaatcgatgcgattttgccgcagagccagtgtggtcagtgcggctatcccggctgccgcccctacgccgaagccgtgggtctccagggcgagaaaatcaatcgttgcgcgcccggcggcgaagccgtcatgctgaaaattgcagagttgctaaacgtagagccgcagccatgcgatggtgaagaacagcaggccgcgccagtacgtatgctggcagttattgatgaaaataactgcattggctgcacaaaatgcattcaggcctgcccggttgacgccatcgttggcgcaacgcgcgccatgcacacggtcatgagcgatctctgtactggctgtaatctgtgcgtcgatccgtgtccgacgcactgcatcgaattacgtccggtgaatgagacgcccgacagttggaaatgggatttgaacaccattcccgttcgcatcattcccgtggaacaacatgcttaa

SEQ ID NO: 7247 - DNA, 579 bp, Salmonella enterica serovar Schwarzengrund CVM19633
atgaatactatctggattgccgttggcgccctgacccttctgggcctggtgttcggcgccattctgggttatgcctcccgccgattcgcggttgaagatgatccggttgttgaaaaaatcgatgcgattttgccgcagagccagtgtggtcagtgcggctatcccggctgccgcccctacgccgaagccgtgggtctccagggcgagaaaatcaatcgttgcgcgcccggcggcgaagccgtcatgctgaaaatggcagagctgctaaacgtagagccgcaaccatgcgatggtgaagaacagcaggctgcgccagtacgtatgctggcagttattgatgaaaataactgcattggctgcacaaaatgcattcaggcctgcccggttgacgccatcgttggcgcaacgcgcgccatgcacacggtcatgagcgatctctgtactggctgtaatctgtgcgtcgatccgtgtccgacgcactgcatcgaattacgtccggtgaatgagacgcccgacagttggaaatgggatttgaacaccattcccgttcgcatcattcccgtggaacaacatgcttaa

SEQ ID NO: 7248 - DNA, 579 bp, Salmonella enterica serovar Dublin CT 02021853
atgaatactatctggattgccgttggcgccctgacccttctgggcctggtgttcggcgccattctgggttatgcctcccgccgattcgcggttgaagatgatccggttgttgaaaaaatcgatgcgattttgccgcagagccagtgtggtcagtgcggctatcccggctgccgcccctacgccgaagccgtgggtctccagggcgagaaaatcaatcgttgcgcgcccggcggcgaagccgtcatgctgaaaattgcagagttgctaaacgtagagccgcagccatgcgatggtgaagaacagcaggccgcgccagtacgtatgctggcagttattgatgaaaataactgcattggctgcacaaaatgcattcaggcctgcccggttgacgccatcgttggcgcaacgcgcgccatgcacacggtcatgagcgatctctgtactggctgtaatctgtgcgtcgatccgtgtccgacgcactgcatcgaattacgtccggtgaatgagacgcccgacagttggaaatgggatttgaacaccattcccgttcgcatcattcccgtggaacaacatgcttaa

SEQ ID NO: 7249 - DNA, 336 bp, Shewanella oneidensis
atgaacggaaacaacagtatcaatatgaatatagataatgcagctaaagtattgaaagaactaggacatcctactcgtcttgccctgttcagaatattagttaaggggggctatgagggcgttgccgtggggcaattacaggaagagttgcaggtcccaggttctacactctcacatcatattagcgccttagtttcagcgggaattatctcgcagcgccgtgagggaagagtattgtactgcgtacctgattatcaattattacaaggactcgtgcattttttacaggatcaatgttgtagtgctcagcgcccgaaaatagagatagaaccataa

SEQ ID NO: 7250 - DNA, 291 bp, Colwellia psychrerythraea 34H
atggatatagatgtaattgccaaagccttaaaagaattaggccatccaactcgattagcaatatttaaacgcttagtaaaatcaggtgagcaaggtattgctgtgggtgaagtgcaagaagagttacagatacctggttcaacattatcacatcacatctctagtttggcttctgcagggttgattacacagcgtcgtgaaggacgggttctttattgcgtcgttgaatatgacaaattgctttctgtgattgcatttctacaagacgaatgttgtattgatgagcagtaa

SEQ ID NO: 7251 - DNA, 336 bp, Jannaschia CCS1
atgaaacagacggcacctcctcttcccgaactgacccttgctgccacagccttcgcagcgttggggtccgagcaacgcctggccatcgtgcgccgtcttgtgcgcgcaggccccgatgggctgacgatgggggatcttggggcagatgttggtgttgcaggctccgtcctgacgcaccacctcaaacagctggtctcggcggggcttgtgagccaacgcaaagacgggcggcgcattctgtcgcgcatagaccacccggcgattgaagcgttgtccgcgttccttatcgctgaatgctgcgccgatgctggcggacacggagatcaccatggctga

SEQ ID NO: 7252 - DNA, 324 bp, Ruegeria sp. TM1040
atggatgaggctgttgccgcgcagggctttgctgcgatgggatctgaggctcgccttgaagtgctgcgcgtcctggtacgcgcaggagaaacaggggtgagcgttggcgatattcgcgagcgcaccgggatcgcagcgtcgactctggcgcatcacttgaaattcctggctgccgccggcgtggtctcgcaggagaaagtcggccggagcacgatctgtcgtgccgatctggcgcatctggagcgtcttgcggggtatatcctgagcgaatgctgtctagatgaaaaactggggcaggttgcaagggtggcaaacgatggctga

SEQ ID NO: 7253 - DNA, 294 bp, Shewanella frigidimarina NCIMB 400
atgagtatcgagatagttgctaaagcattgaaagagttaggtcatccgacacgattggccgtttacaaacaggttatgaaagcgggaccaaagggcgttgctgtcggtaagttaggtgacaatattggtatacccaattctacattgtctcaccatatctcaagtatgatcaccgcgggattgattacacaacatagggaaggcagggttttatattgtatcgccaactatgaaatgcgtgaaaatgtactcaacttcttgcaacaagaatgctgtatcgacagtactttttaa

SEQ ID NO: 7254 - DNA, 288 bp, Shewanella sp. ANA-3
atgaatacagaaaatgcagctaaagtattgaaggagctagggcatcccactcgtcttgccctgttcagaatattggtaaaaggcggttatgggggcgttgccgtggggcaattacaggaagcattacagatcccaggttcaacactctcacaccatattagcgccttaatgtcggccggcattatctcccagcggcgtgagggcagggtgttatattgtgtgcctgactatgaattattacagggactggtgcattttttacaggatcaatgttgtagtgaacaatga

SEQ ID NO: 7255 - DNA, 288 bp, Shewanella putrefaciens CN-32; identical to SEQ ID NO: 7254

SEQ ID NO: 7256 - DNA, 294 bp, Vibrio harveyi ATCC BAA-1116
atggaactcgaagctgtagcaaaagcgctcaaagagctaggacaccctacccgtttatgtatctataaagaggtggtcaaagcaggctatgaaggaatcgcggttggtggcgtacaagataaacttggtattccagcctctaccctttctcatcacatttcgagcctagcctcagccggcttaatcagtcagcgtcgtgaaggtcgtactttatattgtgttgccgagtatgaatgcttagatacggttattggtttcttgcgtgacgagtgttgcatcaatgaaaactgctaa

SEQ ID NO: 7257 - DNA, 297 bp, Escherichia coli E24377A
atgcagttggaagaagttgctaaagcgctgaaagagctaggtcacccgacccgtttgttcatattcaaacacctggtcaaagcgggggagcaaggtttgccggtcggtgagttgcaaaagcagcttgggatacccggctctacactcagtcaccatatttcagcactggtatcggtagggctggttaaacaaaaccgtgagagtcggacgctgatgtgtgtttcgcaatacgcaatgctggaagcgataattgaattcttacgcgaggagtgctgcgtaaatagcaaaattgcctga

SEQ ID NO: 7258 - DNA, 345 bp, Dinoroseobacter shibae DFL 12
atggaaacgaaaaccgactcacgcgcccaagcggcggctgcctttgccgcccttggtgccccccagcgcctcggcgtgctcgaagtgctggtgcgcgcaggtcccgaagggctgcccatcggtgttctcggggcacgggccggtgtcagcggatcgaccctgacacatcatgtcaaaaccctcgtgcaggctggtctcgtccagcagacccgcgagggtcggatcatccgctgcaccgtcgtctatgaccgggtgacgggcctttccgactaccttctggcgcaatgctgcgccgatacgcccacaggacacgaccatggccgagacctccacacagcctcctga

SEQ ID NO: 7259 - DNA, 312 bp, Shewanella woodyi ATCC 51908
atgactggagctagaatggatcttgagtttgcagctaaagcgatgaaagagttggggcacccgactcgcttggctatctttaaacgtttggtaaaatcgggttatcaggggatcccagtaggggaggtacaggaggagctcagtattccaggttcgaccctttctcatcatatctcaagcttaatttcggcaggacttgttaagcagcatcgtgaaggtcgggtgctgttttgtgtgccgcagtatgaggttttgcaggaggttattgattttctccaggcggaatgttgcagcgcgcagaagtgtgggtaa

SEQ ID NO: 7260 - DNA, 324 bp, Escherichia coli SMS 3 5
atgcaactggaagaagtagctaaagctctaaaagaactgggtcacccgacccgtttgttcatattcaaacatcttgtaaaagctggagaacaaggtttacctgtaggtgaattgcaaaagcagcttggcattccttcatcaacgttaagtcatcatatttcagccctggtatcagtaggactcgtcacacaaaaccgggagagtcgaacgctcatgtgcgtctctcaatatgaaatactggaagctatcatcgaattcttacgtgaagagtgctgtgtaaacagtaaaacagatgttgcggaacccgctggcaaaaatgggtaa

SEQ ID NO: 7261 - DNA, 321 bp, Escherichia coli SMS 3 5
atgcagttggaagaagttgctaaagcgctgaaagagctaggtcacccgacccgtttgttcatatttaagcatctggtcaaagcgggggaacaaggtttgccggtcggtgagttgcaaaagcagcttgggatacccggctctacactcagtcaccatatttcagcactggtatcggtagggttggtcaaacaaaaccgtgagagtcggacgctgatgtgtgtttcgcaatacgcaatgctggaagcgataattgaatttttacgtgaggagtgctgcgtaaacagcaaaacagatggcgaaggagccacgaagaacaaataa

SEQ ID NO: 7262 - DNA, 465 bp, Brucella suis 1330
atggctcatccccaagttggcgatatggcaccggattttaccctaccatccgaccatggcgaaattaccctgtcatcgctgaaaggccaccctgtcgtcgtctatttctatccaaaggacgacacatcgggctgcaccagggaagccatcgccttttcgcagttgaaggccgaattcgacaggatcggcgtgcgcgtgatcggtctttcacccgatagcgcaacgaaacatgccaggttccgcaccaaacatgcgctgacggtggatctggtggccgatgaagatcgcgtggcgcttgaagcctatggcgtgtgggtggaaaaaagcatgtatggacgcaaatatatgggcgtggagcgcacgacctttctgattggcgccgatggacgcatcgctcaggtctggaacaaggtcaaagtcgatggacacgcccaagccgttcttgaagccgcccgcagactctga

SEQ ID NO: 7263 - DNA, 630 bp, Nitrobacter winogradskyi Nb-255
atgtccaagaagatacgcaagaaatcctcgaaatccgacagttctgtaacggtgcgggcggcaactgtcgctcacacggaacaggctcgcgaggccggcccgtcaccctccccggcagcgaccacaaaaaccaagccgcgccctgctccgccggcctctcaaggcgccgggctcgcggaaggctccccggccccgccattcaaccttcccagggaagacggcgccttggtttcgcttgctgatttcgcgggaggaaagctcgtaatctttttctatccgcgcgcgggaacgccgggctgcaccatagaggccatggacttcacccggctggcgactgatttcgcggtcagtggaacggcggtgatcggcgtatcggctgatccggtaaaggcgcagctttcgtttcgaaacaagcaccagctgtccattgctctgatatcggatgaaaagcaccaaatgctggaggcttatggggtctggggtgaaaagtccatgtacggcaagactttcatgggcgttcttcgcacaaccgtactggtggatggggccggacggatcgctcgcatctggcgcagggtcaaggtcgaaggtcacgcggacgaggtgctcgcggccgcgcgcgaactgtga

SEQ ID NO: 7264 - DNA, 669 bp, Rhodopseudomonas palustris HaA2
atgtccaagcaaacgcgcaagaatccctcgaaatccgaaagcctgaagacgccggcggcgaaatcggcagccgcggccggaatggctgccaagtcgtcccctaccaagaagtcgtcccccaccaagacgaccaaggccaaggcgaagccggcgagcccggccaaggccaaaacgcccgcggccaaacccgccgctccggctgtcgccggtcttgccgagggcgcccaggcgccggccttcacgctgacccgcgacggcggcgaaaccgtcacactggcaagcttttccggaaagaagctcgtgctgttcttctacccgcgcgccaacacgccgggctgcaccaaggaggcgatcgacttcacccgactgaagcccgccttcgagacctgcggcgccgcggtggtcggcgtctcggcggattcggtcaaggcgcaggattccttccgcgacaagcacggcctggcgacaccgctgctgtccgaccccactcacgcgatgctcgaagcgtacggcgcatggggcgaaaaatccttatacggccgaaagttcgagggcattgttcgcagtacggttctgatcggccgcgacggtaaaatcgcgcgggtgtggcgcaatgtgaaggtcgacggccatgccgatcaggtcctcgccgccgcgcaattgctgtga

SEQ ID NO: 7265 - DNA, 462 bp, Jannaschia CCS1
atgcccgaggtaggccagcccgcccccgactttaccctgccacgcaacggcggcggcaccctgacgctgtcggcccaacgccccaagcccgtggtcctttacttctaccccaaggacgacacgcccggctgtacgaaacaggcgatcactttcacggagatggccccccagtttgaggccgcgggcgcggaaatcatcggcatctcgaaggattccgtcgccaagcatgacaagttcatcaacaagcacgcgctcaacattacgctggtttctgacgaagacggcgacacctgcgagcaatatggcacctgggtggagaaaaatatgtacggcaaaaagcacatgggcatcgagcgggccacgttcctgatcgacgcggaggggtccatcgtgcaggtctggcgcaaggtgaaagtcccgggccatgtggaggctgtgctggacgccgtacaggccctctag

SEQ ID NO: 7266 - DNA, 537 bp, Rhodopseudomonas palustris BisB18
gtggaggcggcgggtgccaaaccggttgtcgctgcgccggtcgtcgaagcgccgccgcggagtagcaagggcgtccttgcagaggggcacgcagcaccggccttcgaactgccgcgcgacggcggcggcatggtatcttcgcacagctttgccggacgcaagttggtggttttcttttatccccgcgccagcaccccgggctgcaccaaagaggcgatcgacttcacccgattggccgacgccttcgcgaccgccgggatcggcgtgctcggcatctccgccgacaatctgaaggcccaggatgcatttcgcgacaagtaccaactgaccacgccgctgttgtccgacgagacccatcagatcctcgaagcgtatggcgtctggggcgaaaaatcgatgtacggcaagatctttcaaggcattcttcgcaccacggtgctgatcggcaaggacggccgcgtcggcaagatctggcgcaacgtcaaggttgacggccatgccgacgaggtgctggcggcagcgatcgaattggagtga

SEQ ID NO: 7267 - DNA, 663 bp, Rhodopseudomonas palustris BisB5
atgtccaagcaatcgcgcgacaaatccccgaaatcggcgaccgcgaaaaagccggcggcgaaatctccggcaccggccaagaagtccgccgcgacatccgcgagcaagacggccgttgcaaaggcgaagcctgcggctacggccaaggccaaagcccccggcaaagcgactgcggcgaagcccgcggccccgacagccgccggtctcgccgagggcgccaaggcgccggccttcaccctgccccgcgacggcggcgaatccgtaacactctcaagcttctccggcagaaagctcgtgatcttcttctatccgcgcgcgaacacgccgggctgcaccaaggaggcgatcgacttcacccgtctcaagcaggcgttcgaggcctgcgggaccgcagtggtcggcgtgtccgcggattcggtgaaggcgcaggattcgtttcgcgacaagcacgatcttgcgacgccgctgctctccgaccccacccatgagatgctcgaagcgtatggcgcctggggcgagaaatcgttgtacggccgcaagttcgaagggattattcgaagcacggttctgatcggcggcgacggcaaggtcgcccgtgtatggcgcaatgtgaaggtcgacggccatgccgaccaggtcctcgcagcagcgcaattgctgtga

SEQ ID NO: 7268 - DNA, 636 bp, Nitrobacter hamburgensis X14
atgtccaagaagatacgcaagaattcctccaaaccggatgcccccgaagccgcccgaacggcaacggccggccgcgcaaagtcggcccgcaacgccgatccttcgtcctcgttggcagcgagcgaaaagtccaaatcgggttcggcgaaatcacggcccgagtctcaagggaccgatcttgcagagggctcccgggcaccgtcattcaacctcccccgggaagacggcacccgcgtttcgctcgccgatttcgccggaaggaggcttgtgatctttttctatccgcgcgccggtactccaggctgcaccagggaggcgatggatttcactcggctggcgaaagagttcgctgcctgcggaacgacggtgctcggcgtgtcggccgatcccgtcaagacgcaggactcattccgcaccaagcacaagctgtccattcctcttatctcggatgaaaagcacgacatgctggaagcctatggcgcctggggcgaaaaatccatgtacggcagggtcttcctcggcattcttcgttccaccgtactggtaaatgcggacggtcggatcgcccgcatctggcgccgggtcaaggtcgacggtcacgccgaagaggtgcttgcggcggcccgcgatctgtaa

SEQ ID NO: 7269 - DNA, 462 bp, Ruegeria sp. TM1040
atgctcgaaccctctgacctcgcccccgcgttcactctgccgcgcgatggcggcggtgaagtttccctttcggacctgaagggtcaggtcgttgttttgtttttctatccccgcgatgatacgccgggttgcaccaaggaatccattggattttccgaacacttgcaagcctttgccgatgcgggcgccgctgtctatggcatctcgcgcgacaccgtggccaaacacgacaaatttgtcgccaaacatgggctcaccgtgccgctgttgtcggatgccgaaagcaccatgtgcgaggactatggcgtctgggtggaaaagaacatgtatggccgcaaaagcatggggatcgagcgctcgaccttcgtgatcgaccgcgacggaaagatcgcccggatctggcgcaaggtcaaagtgcccggccatgtcgaagaggttctggaagccgtcaaagagctctga

SEQ ID NO: 7270 - DNA, 477 bp, Mesorhizobium BNC1
atggccatcgtcgaaaaaggagacatagctcccgattttgagctgccgcaggatggcggccgcacgtttcggttgtcgagtttgcgcggaaaaccggtggttctctatttctatcccaaggacgacacttcgggatgcacggcgcaggccatcgaattctcggcccggaaggacgaattcgaagcgctgggtatttccatcgtcgggctttctcccgataccgtgaagagccacgacaagttcaaggccaagcacgatatctccatcagccttgtcgctgacccggagaaaaaggtggtgcaggattatggcgtgtgggtggagaagagcatgtatggccgcaaatatatgggggtggagcgcagcaccttcctgctcgatgccgagggccgcattgcggagctgtggcgcaaagttcagctcaaggggcatgtggatgcggtgctgaaggcggcaaaagccctccgcgattcatag

SEQ ID NO: 7271 - DNA, 462 bp, Rhodobacter sphaeroides 2 4 1
atgaccgatgccggacagaccgcccccgatttcaccctgccgcgcgatggcgggtccaccgtgtccctgtcgggccttcggcccggcaaggtggtggtttacttctatcccaaggacgatacctcgggctgcaccctcgaggcgcaggaattcaccgccctcgcgccgcagttcgccgagatcggcaccaccgtcatcgggatctcgaaggacagcgtgaaatcgcacgacaagttctgcgccaagcacgggctcgggatcgtgctcgcctcggacgagggcgcgaccaccgccgaagattacggcgtgtggaaggagaagaacatgtatggcaagacctacatgggcatcgaacgctccaccttcctgatcgacggcgagggcaggatcgcccgcgtctggcgcaaggtgacggcgcggggccatgcggccgaggtgctcgaagcggcccgctcgctctga

SEQ ID NO: 7272 - DNA, 471 bp, Maricaulis maris MCS10
atgagtgaactcaaaaccggcgaccttgctccgacattcaaactgcccgccgacggtggcggcacgattgacctcgcggacctgcgcggtcagatcgtcgtcctctatctctatccgaaggacgacacccccggctgtaccacgcaggcgctcgatttcactgccgccagcgcagctttccgcgaggccggcgccactatcatcggcctgtcgaaggatagcgtcaaaagacacgacaatttcaaggccaaacatgggcttgaggtgagtctggtctccgaccccgaggcggaggtgatcgaagcctacgggtcctgggtcctcaagaagctgtacggacgtgaatatatgggcattgatcgctcgaccttcctgatcgatcgcgatgggcacgtcgcgcgcatctggcacaaggtcaaagtgaaggggcatgtcgacgaagtgcttgaggcggtccgcgaacttggctga

SEQ ID NO: 7273 - DNA, 462 bp, Rhodobacter sphaeroides ATCC 17029
atgaccgatgccggacagaccgcccccgatttcaccctgccgcgcgatggcgggtccaccgtgtccctgtcgggcctccggccgggcaaggtggtcgtctacttctatcccaaggacgatacctcgggctgcaccctcgaggcgcaggaattcaccgccctcgcgccgcagttcgccgagatcggcaccaccgtcatcggcatctcgaaggacagcgtgaagtcgcacgacaagttctgcgccaagcacgggctcgggatcgtgctcgcctcggacgagggcgcgaccaccgccgaagactacggcgtgtggaaggagaagaacatgtatggcaagacctacatgggcatcgaacgctccaccttcctgatcgatggcgagggcaggatcgcccgcgtctggcgcaaggtgacggcgcggggccatgcggccgaggttctggaagcggcccgctcgctctga

SEQ ID NO: 7274 - DNA, 462 bp, Rhodobacter sphaeroides ATCC 17025
atgatcgacgcaggccagcccgcccccgatttcaccctgccgcgcgatggcggcagcaccgtctctctctcggccctgaagccgggcacggcggtcgtctatttctaccccaaggatgacacgtccggctgcacgctcgaggcgcaggagttcaccgccctcgccgcccagttcgccgagatcggcgcgaccgtgatcggcatctcgaaggacagcgtcaagtcgcacgaccggttctgcgccaagcacgggctgggaatcatcctcgcctcggacgagggcgcctccaccgccgaggactacggcgtgtggaaggagaagaacatgtacggcaagacctacatggggatcgagcgttcgaccttcctgatcgacggcgagggccggatcgcccgcgtctggcgcaaggtctcggcccgcggccatgcggccgaggtgctggccgccgcacgcgaactctga

SEQ ID NO: 7275 - DNA, 708 bp, Bradyrhizobium BTAi1
atgtcaaaggaatcacgaaagaaatcctccaatccgggagtccgcgatgggatcgcggggaaccgggccgcaatggccgccaagaaggccgtcaaaaagaccgccaagcccgtgacgacgaagcctgccaaggcgaccaagacgacaacagccaagacgaccgtcgccaagaaggcagccaagcccgcgaccaagccctcggcgaaggcgaagcccgcatcgaccatccccgctgcaggcggaatcgtactggccgagggcgccaaggcccctgccttcaagctgccgcgcgacggcggcggaaccgtttcgctggccgactatgccggacaaaagctggtgttgttcttctatccgaaagccaatacccccggatgcaccaaggaagcgatcgacttcacccgcctgaccaaggagtttgccgccgccggcaccgcggtgctcggcgtatccgccgattcggtcaaggcgcaggacaatttccgcgacaagcacgatctggccgtgccgctgatctccgacgagacgcacgagatgctggaggcctatggcgcctggggcgagaaatccctctatggccgcaaattcctcggcatcatccggagcacggtgctgatcggcgccgacggccgcgtcgccaaagtgtggcgcaacgtcaaggtcgacggccatgccgacgccgtgctcacggcggcgcgcgagctctga

SEQ ID NO: 7276 - DNA, 464 bp, Brucella ovis
atggctcatccccaagttggcgatatggcaccggattttaccctaccatccgaccatggcgaaattaccctgtcatcgctgaaaggccaccctgtcgtcgtctatttctatccaaaggacgacacatcgggctgcaccagggaagccatcgccttttcgcagttgaaggccgaattcgacaggatcggcgtgcgcgtgatcggtctttcacctgatagcgcaacgaaacatgccaggttccgcaccaaacatgcgctgacggtggatctggtggccgatgaagattgcgtggcgcttgaagcctatggcgtgtgggtggaaaaaagcagtatggacgcaaatatatgggcgtggagcgcacgacctttctgattggcgccgatggacgcatcgctcaggtctggaacaaggtcaaagtcgatggacacgcccaagccgttcttgaagccgcccgcagactctga

SEQ ID NO: 7277 - DNA, 468 bp, Sinorhizobium medicae WSM419
atggcaggattgagacaaggcgatgtcgctcctgagtttgaacttcctcgcgaaggaggtggcactatctcactcgctgccctgcgcggcgggcccgtcgttctcttcttttacccgaaggacgatacgaaaggctgcacgcaggaggccatctccttctcggctctgaaggaggagttccaaagcgcgggaattatgatcatcggcatatcgcccgattcggccaagagccacgatcgcttcaccaggaaacacggcctcaccgttgcacttgcttcggacgaggacaaggccgtggccagcgcctatggcgtgtgggtcgagaagagcatgtatggccgcaaatatatgggtgtcgaacggaccaccttcctgattgacaggcagggcgtcatcagccgcgtctgggagaaggtcaaagtgcccggccacgccgacgaggttctggctgcggcgaaggcaatttga

SEQ ID NO: 7278 - DNA, 465 bp, Ochrobactrum anthropi ATCC 49188
atggctcatccccaagttggcgatccggcacccgatttcactctgccttcggataatggcgaaatctccctgtcgtctctcaaaggcaagccggttgtcatctacttctatccgaaagacgacacgtccggctgcaccaaggaagcgattgctttctcgctgttgaagccggagttcgacaagatcggcgttcgcgtcatcggtctttctcccgatagcgcgacgaaacatgcaaaatttcgcaagaagcacgatctgaccgtcgaccttgctgccgatgaagatcgtgtagcgctcgaagcctatggcgtgtgggttgaaaaaagcatgtatggccgcaaatatatgggcgtggaacgcacgacattcctgatcgatgcagaaggacgcatcgctcaagtctggaacaaggtcaaagtcgacggccatgccgaggcggttctggacgccgcacgcgcgctttga

SEQ ID NO: 7279 - DNA, 507 bp, Parvibaculum lavamentivorans DS-1
atggcaaaagcaacggcaccgaaaagcgccccggcggcgggcggcctgccggccgagggtaagaaggcgcccgctttctcgctgcccgccgacgacggcacaaaagtcacactgaaggcgctcgccggcaagaaagtggtgctttatttctatccgaaagacgacacgcccggctgtaccacggaaggtatcgagttcagcgcactcaagaagaagttcgacgctgcgggcgccgtcgtgctcggcgtctcgaaggatacagtcgacaagcactgcaagtttcgcgacaagcacaatctcacagtgcgcctcctttccgacgaggatggcaagacagttgaggcctatggtgtctggggtgaaaaaagcctttatggccgcaaattcatgggcatcaaccgggtgacattcctgatcgatgaaaagggtgtcgtgcggaaggtctggcccaaggtgaaggtaaagggccatgcggaagacgtgctggccgcagcacgggaaatctga

SEQ ID NO: 7280 - DNA, 474 bp, Xanthobacter autotrophicus Py2
atgtcgcagtttcccgaagccggagccaaggcgccggcgttctcgctcgcccgcgatggcggtggcacggtggcgctcaaggacttcaaaggccgcaagctggtgctctatttctaccccaaggccaacaccaccggctgcaccaaggaagccatcgccttcaacggcctgaaagccgccttcgccgccgccgacaccgacattctcggcgtctcggccgatgcggtgagcgcgcaggacaagttcaaggccaagtacgacctcgcctttccgttgggctcggacccggacaaggcgatgctggaagcctacggcgtctgggtcgaaaagagcatgtacggccgcaagtacatgggcatcgagcgggcgaccctgctgatcggccgcgacggcaaggtggcccgcacctggccaaaggtgaaagtggccgggcacgccgaagaggtactcaaggcggcgcaggagctgggctga

SEQ ID NO: 7281 - DNA, 462 bp, Dinoroseobacter shibae DFL 12
atgatcgaaacaggccaatcagcccccgacttcacactgccgcgggacggcggcgaaacactgaccctgtcggctcagaaaccgcgcaatgtggtgctctatttctacccgcgggccgatacatccggctgcaccaagcaggcggcgggcttcaccgcgcatctggacgcctttgccgccgccaacacggtggtgatcggggtctcgaaggacccggtgaagaagctcgacaagttccgcgacaagcacgggctgtcggttgcgctggtcagcgacgaggagagcacggtctgcgaggattggggcgtctgggtcgaaaagcagatgtacggcaagacctacatggggatcgagcgcgcgaccttcctgatcgacgggaccggcacggtgcgcaacatctggcgcaaggtgaaggtgccgggccatgtggaagaggtgcttgaggccgtcaaggccctgtga

SEQ ID NO: 7282 - DNA, 510 bp, Methylobacterium extorquens PA1
atgggatcaggcacaccatcaatcggccgaaaggaaggcgaaatgccgctagagaccggcaatgccgcgcccctgttctcgttacccggagccggcggcgagaccatctctctcgagagcctgcgcggtcacaagatcgtgctttatttctaccccaaggacgatacgagcggttgcaccctcgaggcgcagaacttcaacgcccagagcgaggccttcgcggcaaccggggcgaaggtggtcggtgtgtcgccggattcggtcaagagccacgataagttcagggcgaagtacggcctgaccttcccgctcgcttccgacgaggcgaaatcgatgctggaagcttacggcgtctgggtcgagaagagcatgtacggccgaaaatacatgggcgtggaacgcacgaccgtgctgatcgaccgcgagggacagatcgcgcgggtctggcacaaggtgaaggtgccgggccatgtcgaggaagttctggaagccgtcaaagccctggcctga

SEQ ID NO: 7283 - DNA, 468 bp, Methylobacterium radiotolerans JCM 2831
atgccgctgtcagagggggatcccgcccccgatttcgaccttcccgcctcgggcggagggcgcgtgggactgtccgcgctccgcggtcacaaagtcgtgctctacttctacccgaaggacgacacgagcggatgcacgctggaggcgcaggacttcaacggtctgctgccggccttcgcggaggcggacgccaaggtcgtcggcctgtcgccggacccggtgaagagccacgacaagttctgcggcaagtacggcctgaccttcccgctcgccgcggacgaggacaagaccgtgctcgaggcctacggcgtctgggtcgagaagagcatgtacgggcgcaagtacatgggcgtggagcgcaccaccgtgctggtcgaccgggaggggcgcgtcgccaggatctggccgaaggtgaaggtgcccggccacgccgaggccgtcctggcggccgcccgcgcgctgccctga

SEQ ID NO: 7284 - DNA, 474 bp, Beijerinckia indica ATCC 9039
atgagcaaaaaactggaagccggtgacacggcgccagaatttcacctgccagatgatcgtggcgggaccttgtccctcgccgatttcgcgggaaaaaagctcgttctctatttctatcccaaggacgatacatccggctgcaccaaggaggcgatcgatctcaatggcctcaagggtgatttcgacaaggcagggacgaacatcctcggcgtctcgcctgattccgtcgccagccacgtcaagttcaagaccaagcacaagctcgatctcgcgctcggttccgacgaaacgaaagccatgctcgaaacctatggcgtctgggtcgagaaaagcatgtatggccgcaaatatatgggcgtcgaacgcacgaccttcctcatcggccccgatggcaagatcgccaagatctggcgcaaggtgaaagtacccggccatgccgaggctgtcttggaggctgcgcgcgccctcgcgtga

SEQ ID NO: 7285 - DNA, 468 bp, Methylobacterium populi BJ001
atgccgctagaacccggcaatgccgcgcccctgttctcgttacccggagcgggtggagagaccatctctctcgaaagcctgcgtggtcacaagatcgtgctctatttctatcccaaggacgacacgagcggttgcaccttggaggcacagaacttcaacgcccagagcgacgccttcgccgccgccggggcgaaggtgatcggcgtctcacccgactccgtgaaaagccacgataagttcagggcgaagtacggcttgacctttccgctcgcgtccgacgaggcgaaatcgatgctggagacctacggggtctgggtcgagaaaagcatgtatggccggaaatacatgggcgtcgagcgcacgaccctgctcatcgaccgggagggacggatcgcccgggtttggaacaaggtgaaggtgccgggccatgtcgaggaggttctggcggccgcccaggccctcgcttaa

SEQ ID NO: 7286 - DNA, 717 bp, Rhodopseudomonas palustris TIE 1
atgcccaagccgacgcccaagaaaccatccaagaagaccgccaagcccgcggtcgagaaaacctccaaggtgacgacgaaggcggcagccaagaccaccgccgcgaaaaccacggccgtgaagaaggccgccgccaagtcacccgctgcaaaggcgcccgcagccaagacggcggcgacgaaggctgccgcaaagccagcggccaaatccgccgcccccaaaccctcggcgaccaagtcctccgccaccaagccagcgggcctggccgaaggcagcgtcgcgccggacttcaagctgccgcgcgatggcggcggcgagatctcgcgcgccgacttcgccggtcgcaagctggtgctgttcttctacccgaaggccaacacacccggctgcacccgtgaggcgatcgacttcacccgcctcgccgccgatttcaaagcctgcggcacggccgtcctcggcgtctcggccgactcggtgaaggcgcagaactcgttccgcgacaagcatcagctggcgacgccgctattgtccgaccccacgcacgcgatgctcgaagcgtatggtgcctggggcgagaaatcgttgtacggccgaaagttccaagggattattcgcaccacggttttgatcgacgccgatggccgcgtcgcgcgggtgtggcgcaacgtgaaggtcgacggccacgccgatcaggtgctcgctgccgcgcaatcttga

SEQ ID NO: 7287 - DNA, 465 bp, Methylobacterium sp. 4-46
atgccgctgaaatctggtgaaccggcccccgatttctcgcttccggcgaccggcggcgagacgatcagtctcacctccctcaagggccgcaaggccgtgctgtatttctatccgaaggacgacacgagcggctgcaccctggaggccaaatccttcaacgatctgcgggaggcgttcgcggccgccgacacggcggtgatcggggtctcgcctgacccgatcaggagccacgacaagttccgcgagaagtacggcctcgctttcccgctcgcctccgacgaggagaaggcgatgctggaggcctacggggtctgggtcgagaagagcatgtacggccgaaagtacatgggcgtggagcgcaccaccgtgctgatcgaccgcgacggccgcgtcgcccaggtctggcccaaggtgaaggtgccgggccacgccgaggcggtcctggcggccgccaaggcgctctga

SEQ ID NO: 7288 - DNA, 474 bp, Rhizobium leguminosarum bv  trifolii WSM2304
atggcggttcccggcatcggcgccacggctcctgatttcaaccttccccgcgacggcggcggccgcatctcgctggccgaattccagggtcggccgctcgttctgttcttctatcccaaggacgatacgacaggctgcaccgccgaatcgctggctttcaccgcgctggcaagcgagttcgaagcggcgggtgcggccgtcatcggcatgtcgcccgattcggccgcctgccatgacaagttcatcaggaagcaccgtctttcggtagcgctcgcctcggatgaggaaaagacgacgctgcaggcctacggcgtctggaaggaaaagagcatgtacggccgcaatttcatgggcgtcgagcgcaccaccttcctcatccgccaggacggcacgatcgccaccatctggcagaaggtgaaagtgcagggccacgccgaaaccgtgctcgaggccgtgcggaatctggctgcgtga

SEQ ID NO: 7289 - DNA, 486 bp, Methylocella silvestris BL2
atgacgcgcgcggcagggggaaaatgcgagccgggaatggctgcgccggagttcaagcttcccggcgatcgcggtgagccgatctcgctgcaaagcttcaaagggcgcaaactcgtgctctatttctatccgaaggacgacacctcgggctgcaccaaggaagcgatcgatttcaatcagctgaagccggagttcgaaaaggccggcgccgcgatccttggcgtctcgccggatacggtggcaagtcacgtaaagttcaagacaaagcaccagctcggcctcgatctcgcctcggacgaatccaaggcaatgctcggcgcctatggcgtctgggtcgaaaagagcatgtatggacgcaaatatatgggcgtcgaacgcaccactctgctgatcgacaggcagggcgtcatcgcgcagatctggtcgaaggtgaaggtgccgggacacgccgaggccgtgctggcggcggcaaaggcgctgccctga

SEQ ID NO: 7290 - DNA, 468 bp, Methylobacterium chloromethanicum CM4
atgccgctagagaccggcaatgccgcgcccctgttctcgttacccggagccggcggcgagaccatctctctcgagagcctgcgcggtcacaagatcgtgctttatttctaccccaaggacgatacgagcggttgcaccctcgaggcgcagaacttcaacgcccagagcgaggccttcgcggcagccggggtgaaggtggtcggggtctcgccggattcggtcaagagccacgataagttcagggcgaagtacggcctgaccttcccgctcgcttccgacgaggcgaaatcgatgctggaagcttacggcgtctgggtcgagaagagcatgtacggccgaaaatacatgggcgtggagcgcacgaccgtgctgatcgaccgtgagggacaaatcgcgcgggtctggcacaaggtgaaagtgccgggccatgtcgaggaagttctggaagccgtcaaagccctggcctga

SEQ ID NO: 7291 - DNA, 465 bp, Methylobacterium nodulans ORS 2060
atgcccctgaatcctggcgatcccgcccccgatttctccctgccggccaccggcggcgagacgatcagcctcacctgcctcaagggccgcaaggccgtgctctacttctacccgaaggacaacacgagcggctgcaccctggaggcgaaggccttcaacgatctgcgggacgccttcgcggccgccgacacggtggtgatcggggtctcgcccgatccgatgaagagccacgacaagttccgcgacaagtacgggctcggcttcccgctcgcctccgacgaggagaaggcgatgcttcaggcctacggcgtctgggtcgagaagagcatgtatggccggaaatacatgggggtggagcgcaccaccgtgctgatcgaccgcgacggccgaatcgcggaggtctggccgaaggtgaaggtgccgggccatgccgaggcggtgctgaaggcggccaaggccctgtag

SEQ ID NO: 7292 - DNA, 474 bp, Agrobacterium vitis S4
atggcggaattgtcgattggggacatggctccggatttcacgctaccgcgcgatggcggcggcacggtgagcctctcttccttcaagggcaagcaggtggttgtctatttttatcccaaggacgataccagcggctgcaccgtagaagccacgtccttcacatccctgacaccggaattcgagagttccggtgctgttatcatcggcatttcccctgatacggtgaaaagccacgataaattcgtcgccaaacacggacttgccgtcatgctcggctcggacgaggagaagaccacgctggaagcctacggcgtgtggaaggaaaaaagcatgtatggcaagacctatatgggggtcgagcgcagcaccttcctgatcgatgccgatggccggatcgcaggcgtctggcgcaaggtgaaagtccctggtcatgctgaggcggtgctgcaagccgtaaaagacaaagcagcatag

SEQ ID NO: 7293 - DNA, 474 bp, Rhizobium leguminosarum bv  trifolii WSM1325
atggcggttcccggcatcggcgtttcggcccctgatttcaaccttccccgcgacggcggcggccgcgtttcgctggccgaattccacggcaagccgctggtgttgttcttctatcccaaggacgacacgacgggctgcaccgccgaatcgctggctttcaccgcgttagcagccgagttcgaagcggcgggtgctgccgtcatcggcatgtcacccgattcggccgcttgccatgacaagttcatcaagaagcaccgtctttcggtggcgctcgcctcggacgaggaaaagacgacgctgcaggcctatggcgtctggaaggaaaagagcatgtacggccgcaacttcatgggcgtcgagcgtaccactttcctgatccgccaggacggcacgatcgccaccatctggcagaaggtgaaggtgcagggccatgccgaaaccgtgctcgaggccgtgaggaacctggcagcgtga

SEQ ID NO: 7294 - DNA, 240 bp, Thermobifida fusca YX
gtgattatcgtcggtctctctattgccttgatggtcgtcagcgtactgatgatcatgctggtgctgctccacaagggtaaaggcggcggcctctccgacctgttcggtggcggcgtcacctcttccttggggggctcatcggtggtgcagcgcaaccttgaccggttgacgatcgccaccgggcttgtctggatcgtcggtatcgtcgcgctcggcctgctcattctccgacagggctag

SEQ ID NO: 7295 - DNA, 231 bp, Frankia CcI3
atgacgatcggtctgtcgatcgccctgattgtcgcgagtattctgatgatcatgcttgtgctgttgcaccgagccaagggaggcgggctgtccaccctgttcggcggcggcgtgtcctcgtcgctgggtgggtcctcggtcgtggagaagaacctcgaccggttgaccatcgctgttgggatcatctggttcacctgcatcgtcggtctcggtctgctgctgaagaattga

SEQ ID NO: 7296 - DNA, 234 bp, Mycobacterium MCS
atggttctcgcactgcagatcacgttgatcgtcaccagcttgctggtggtgctcctggtgctgctgcatcgtgccaagggcggcggtctgtccaccctgttcggtggcggcgtccagtcgagcctctcgggctccacggtcgtcgagaagaacctcgaccggttgacgctgttcgtcgtcggcatctgggtggtctcgatcgtcggcgtggcgctgcagatcaagtacagctga

SEQ ID NO: 7297 - DNA, 225 bp, Rubrobacter xylanophilus DSM 9941
atggtctacgtgcttgcttttctgcacctggtcttctgcatagccctcgtgggcctcatcctgctgcactcgggcaagggcggcgggctctcggcctccctgggcggcggggtgggaggtcccttctccggcacgaccatcatggagaagaacctcacccgcctcaccctggtggtgctgggcctcttcgtcctcaccaacgtggccctggtcttcctgggctag

SEQ ID NO: 7298 - DNA, 258 bp, Arthrobacter FB24
gtggacgttcttcatgtcattctgcagattctcctgggcatcaccagcctcctgctgacgctgctcatcctgctccacaagggacggggcggcggtctgtcggacatgttcggcggaggcatgagctcgggcctcagctcgtccggtgtggcggagcgcaacctcaacaggttcacggtcatcctgggcgtcacctggggagtcgtcatcatcgcactcggcctgctgatgcgcttctccgggggcggcgactcctag

SEQ ID NO: 7299 - DNA, 231 bp, Nocardioides JS614
gtgaccctgctcttcacgatcctgctcatgatcacgagcgcactgatgatcgtcctcgtcctgctccacaagggccgcgggggcggtctctcggacatgttcggcggcggcgtctccagctcgctgggtggctcgtcggtggccgaacgcaacctggaccggttcacggtcggggtcggcatcatctggttcgcctgtgtagtggccctcgggctcctgttcgcctactga

SEQ ID NO: 7300 - DNA, 234 bp, Mycobacterium KMS; identical to SEQ ID NO: 7296

SEQ ID NO: 7301 - DNA, 234 bp, Mycobacterium vanbaalenii PYR-1
atgcaattggccctgcagatcaccctggtcgtgaccagcgtgctggtcgttctcctggttctgctgcatcgcgccaagggcggcggcctgtccagcctgttcggtggtggtgtgcagtcaagcctgtccggctccaccgtcgtggagaagaacctcgaccggctgacgctgttcgtcaccggcatctggatcgtctccatcgtggggatggccctgcagatcaagtacggctaa

SEQ ID NO: 7302 - DNA, 234 bp, Mycobacterium JLS
atggttctcgcactgcagatcacgttgatcgtcaccagtttgctggtggtgctcctggtgctgctgcatcgtgccaagggcggcggtctgtcgaccctgttcgggggcggcgtccagtcgagcctctcgggctccacggtcgtcgagaagaacctcgaccggttgacgctgttcgtcgtcggcatctgggtggtctcgatcgtcggcgtggcgctgcagatcaagtacagctga

SEQ ID NO: 7303 - DNA, 237 bp, Mycobacterium gilvum PYR-GCK
atgcaattggccctgcagatcaccctggtcgtgaccagtgtcctggtcgtcctcctggtcctgctgcaccgtgccaagggtggcggtctgtccagcctgttcggcggcggtgtgcagtccagcctgtccggttccacggtggtcgagaagaacctcgaccgggtgaccctgttcgtcaccggcatctggatcgtgtcgatcatcggtatggcgctgtccatcaagtacggcgtctga

SEQ ID NO: 7304 - DNA, 261 bp, Salinispora tropica CNB-440
atgccgatctggttcgcgtacacgttgatcgtgttgctggtcattacgagcttcatgctcgtcctgctgatcctgctacaccggggtaagggcggtgggatgtccagcatgttcggcggcggggtcagctccagcctggcgggatcgtcggtcgccgagaagaatctggaccgctacaccgttttggtgggcatcgtctggttcgcctgcatcgtcgggctcgggctctggctgcgtctccagcagtccagcctcggctga

SEQ ID NO: 7305 - DNA, 231 bp, Frankia EAN1pec
atgacggtcggtctgtcgatcgccctgattgtcgcgagtgtgctgctggtgctgctggtgctgctgcaccgggccaagggcggcggtctgtcgacactgttcgggggcggtgtctcctcgtcactggggggatcgtccgtggtcgagaagaatctcgaccgcctcaccgtcgcggtggccctattgtggatcacctgcattatcggtctcggtctgctcctgaagaattga

SEQ ID NO: 7306 - DNA, 261 bp, Salinispora arenicola CNS-205
atgccgatctggttcgcgtacacgttgatcgtgttgctggtcattacgagcgtcatgctcgttttgttgatcctgctacaccggggtaaaggtggtgggatgtccagcatgttcggcggcggggtcagctccagcctggcgggttcgtcggtcgccgagaagaacctggaccgctacaccgtcctggtgggcatcgtctggttcgcctgcatcgtcgggctgggtctctggctgcgcctgcaacaggccagcgtcggctga

SEQ ID NO: 7307 - DNA, 249 bp, Bifidobacterium longum DJO10A
gtgaccgctcttaagatcacgctgcaagtcatcgtcgtgctgctcagcttcgtgctgaccctgctcatccttatgcacaagggcaagggcggcggtttgtccgacatgttcggcggcggtctgacccagaacgccggtacttccggtgtcgccgaaaagaacctgaaccgttggaccgttatcatcgctctggtgtgggtggccttgatcatcggcctcgacatgatgaccaagttcaacctcggctga

SEQ ID NO: 7308 - DNA, 258 bp, Arthrobacter chlorophenolicus A6
gtggacgttcttcatgtcatcctgcagatcctcctgggcatcaccagcctcctgctgacgctgctcatcctccttcacaaaggacgtggcggcgggctgtcggatatgttcggcggcggcatgagctcaggactcagctcatccggtgtggctgaacgcaacctcaacaggttcaccatcatcctcggcgtgacctggggcatcgtcatcatcgccctgggcctgatcatgaggttcagcggcgccggggactcctga

SEQ ID NO: 7309 - DNA, 228 bp, Acidimicrobium ferrooxidans DSM 10331
atgttgaccgtcgtgctcgtcgtcgtgcaggtcgtcagcgcgatcgggatggtggtcttcgtcctgctgcactcgggcaagggtggtggattgtcggacctcatgggcggctcgagcttgagctcggccgcgagttcgtcggtggctgagcgcaatctcgaccacatcaccatcgtgctggcactggcgttcgccctgtcgagcatcgcgctcgggctccgcctgtag

SEQ ID NO: 7310 - DNA, 234 bp, Actinosynnema mirum DSM 43827
atgaacactttcctgcagatcctcctgatcgtgtccagcctgctgctcatcctgctggtgctgctgcaccgcggtcggggcggcggtctgtcttcgctgttcggtggcggtatgcagtcgagcctgtccggttccagcgtggtggagaagaacctggaccgcctgacgctgttcgtcggcgcgatctgggtgatcgccatcgtgggcatcggcttgattcagaaggtcgcctga

SEQ ID NO: 7311 - DNA, 246 bp, Beutenbergia cavernae DSM 12333
gtggacgctctacgcatctccctgcaggtcctgctcgtgctcacgagcgggatcctgatcctgacgatcctcatgcacaagggcaagggcgggggcctctccgacatgttcgggggcggactgtcgaccagcgtcgcgtcgtcgggcgtcgccgaacgcaacctcaaccgcatcaccatcggcaccgccctcatctggggcgtcgtcgtggtgctgctgggtctgatccagaagttcacggtctga

SEQ ID NO: 7312 - DNA, 300 bp, Brachybacterium faecium DSM 4810
gtggcgtatgctggatcggtccgcctgtctccgtggaaggtgtccgtcctcgtggatctgcctctgctgaagctcatccttcagatcctgctggccgtgctcggcctgctgaccatcatgctcgtcctgctgcacaaggggcgcggcggcggtctgtccgacatgttcggcggcggcgtctcctcctcggccagcgcctccggtgtggcggagcggaacctgaactggctcaccgtctccgtcgccgtggcctggggcttgagcgcggtcgccctgggcgtcatcgagaagctgctctga

SEQ ID NO: 7313 - DNA, 252 bp, Micrococcus luteus NCTC 2665
gtggacgtcctgaccctggccctgcagatcctcgtggtcgtgctcagcatggtcatcgtgctgctcatcctgctgcacaagggccgcggcggcggcgtctcggacatgttcggcggtggcgtgaccacctcgatgagctcctcgggctccgcccagcgcctgctcacccgcctgaccgtcggctccgtggtcgcctggggtgtcgtgatcgcgctgctcggcgtcctgccgcgtctgaccctggagtcctga

SEQ ID NO: 7314 - DNA, 234 bp, Kytococcus sedentarius DSM 20547
atggacatcatccgcctcctcctcgacggagcgctcgtgatcacgagcctcttcctcgtgctgctcatcctcatgcacaaggggcggggcggtggtctgtcggacatgttcggtggtggcatctccgccaccggcgggtcctccacggtggccgagcgcaacctcaaccgcatcaccgtcggcatggcggtcgcgtggttcgccaccgtggtggccctgggcatcatcaagtaa

SEQ ID NO: 7315 - DNA, 246 bp, Catenulispora acidiphila DSM 44928
gtgactctttaccagtggatcgtctcaggcatcctggtcgcgaccagcctgctcctcatcatgtcggtgctcctgcacaagggtaagggcggtggcctgtccgacatgttcggcggcggcgtgtccggcggcctgcagggttcctccgtggtggagcgcaacctggaccggatcagcgtcgtcctgtcgtcggtctggatctcctgcatcgtggctctcgcgctgctgtacaagcacaacgtctaa

SEQ ID NO: 7316 - DNA, 231 bp, Saccharomonospora viridis DSM 43017
atggaactgttcctgcaaattttgttgatcgtctccagcgtgctgctgatcatcgcggtgctgctgcaccgtggtcgaggcggcgggctgtcgtccctgttcggtggcggtatgcagtcgagcctttccgggtcgagcgtggccgagaagaacctcgaccgcatcacgctcgggatcggtgctgtgtgggtgatcgccatcgttgggctcggtctgctggtgaaactctga

SEQ ID NO: 7317 - DNA, 246 bp, Jonesia denitrificans DSM 20603
gtggatattctgcgcatctcacttgaagtgctccttgtcgtgacttcgatcctcctgatccttttagttcttactcacaaaggcaagggcggtggcatgtctgacatgttcggtggtggtgtctccacatccatcggaaacgcaggcaacgcccaaacaaacctcaaccgtattactatcgccttcgcgatcgtttggttcgcggctatcgtcttgttggggctcttcccaaaggtcaccggctaa

SEQ ID NO: 7318 - DNA, 252 bp, Atopobium parvulum DSM 20469
gtgggcgttctgaatacaattcttttagtgctgtttatactttctggcattttgacggtgttgcttgttctggcacactccggaaagggcactggcgtttctgacatgattgctgcatctatgtataacgcaagtgctggttcaggcattatggagaagaatcttgatcgtcttaccatcattactacaaccatcttcctggtttgcgctattgtgatggctctgacattccctgttggctctattggttaa

SEQ ID NO: 7319 - DNA, 237 bp, Nakamurella multipartita DSM 44233
atgattctcttcctgcagatcctgctcgtcatcaccagcctcacgctgatggcgttgatcctgttgcaccgcggcaagggtggcgggctgtcgtcgctgttcggcgggacgatgcagtcgtccctgtctggatcgtcggtggtggagaagaacctggaccggctgaccctgttcgtcgcggccgtctgggcgatctccatcgtcggcgtcgggttgctgctcaaggtcggtgcctga

SEQ ID NO: 7320 - DNA, 462 bp, Brucella suis 1330
atgagcacgctagaggccaattccgagcagaacatgcaggttttcggcggcaaaaacccgaaagccatcctgcccaagcgcccggtgggggaagccctgtggcgtggcttccgctgccgatgcccgcattgcgatgaaggcaaattgttccgtgccttcgtgaagccggtcgataaatgcatggcctgcggtgaagactataccgaacagcgcgcggacgacctgcccgcctatctcaccattctcgtcgtcggtcatatcgtcgtcggcctgttcatgggtgtagaggcgacgaccaacctgtcgctgtgggcgcatatggcgatctgggggcctatgacgctcatcatgtccctgcttctgctgcaacccatcaaaggttcggtcatcggattgcaatgggcgctttacatgcacggtttcgggggcgaaaacgaaagcgaatacggcgacgccgcttga

SEQ ID NO: 7321 - DNA, 441 bp, Nitrobacter winogradskyi Nb-255
atgaccgcgcttcctcccgataccgcgagcacagcaggcaaaacctggaccccggaaggcgaaaagcgcgacacctgggccgcgatgaggcgcgggttattctgccgctgcccgagatgcgggcaaggcaaactttttcgtaccttcctgaaaaccgccgacaattgttcggaatgcggacttgattttactccccatcgcgccgacgacctgcccgcctacctcgtcatcgtcgtcgtcggccacattgtcgtgccgctggcgctgctgatcgagaaagcgtttgctccgccgctgatccttcaatgggcgatctatctgccgctgacgctgatcatggcgctgtggctgattcagccgatcaagggtgcggtcgtcggcctccaatgggccctccgcatgcacggctttgacgagaattttgtcgacgaccaggtctga

SEQ ID NO: 7322 - DNA, 432 bp, Rhodopseudomonas palustris HaA2
atgaagaccgttgtgaatcgtgcaccgatcgtctggccgtcggacaacgctcccgccgaagatcgcaatgtctggcaggcgatgtggcgcggctttcgcggccgctgcccacaatgcggcgaaggcaagctgttccgcggcttcctgaagaccgccgacaactgctcgcattgcggtcaggatttcaccggccaccgcgctgacgacctgccggcctatttggtgatcgtcatcgtcggccacatcgtggttccgatcgcgctgtcgatcgagaccaatttctcgccgccggtgatgttgcagctcgcgatctatctgcctatcacgttgttcgcatcgctggcgctactgcagccggtgaagggcgcggtggtcggcttgcaatgggcgttccggatgcacggcttcgacgagaacaatcctgagaagtga

SEQ ID NO: 7323 - DNA, 450 bp, Rhodopseudomonas palustris BisB18
atgagcgtcgacgacagcgcagcgcggcccgcccgcagctggagcgcggaggtcattgcgccggagaagcgcaacgccgtcaccgcgatcaagcgcggcttgttcggccgctgcccgcgctgcggcgagggcaagctgttccgcgcgttcctcaaggtcgacgatcactgcgccaagtgccagctcgacttcaccccgcatcgcgccgacgacctgccggcctatctggtgatcgtcatcgtcggtcatctggtggtgccgatcgtgctgtggatcgagaccaattattcgccggcggtgccgctgcagctggcgatctatctgccgatcacgctgctgctgtcgctgggattgctgcagccggtgaagggcgccgtggtcgggctgcaatgggcgttccggatgcacggcttcgacgacaatccccctggcgatatccccgcggtctag

SEQ ID NO: 7324 - DNA, 432 bp, Rhodopseudomonas palustris BisB5
atgaaaaccgttgtgaatcgtgcgcccatcgtgtggccgtcggacaacgctcccacggaggaacgcaacgtctggcaggcgatgtggcgcggctttcgcggccgctgcccgcattgcggcgaaggaaaactgttccgcgcgttcctcaagaccgccgatgcctgcggccattgcggtcaggatttcagcggtcaccgcgccgacgatctgccggcctatctggtgatcgtcatcgtcggacacatcgtcgtgccgatcgcattgtcgatcgaaaccaacttcgcgccgccggtggcattgcagctcgcgatctatttgcctatcacgctgctcgcatcgctggcgctgctgcaacccgtcaagggcgcggtggtcggtctgcaatgggcttttcggatgcacggcttcgacgaaaacaatccggaaaagtag

SEQ ID NO: 7325 - DNA, 441 bp, Nitrobacter hamburgensis X14
atgacggcgcctcctcccaacaccgcgagcacagccgccacaatctggaccccggaaggcgagaagcgccacctctgggccgcgatgaagagaggctttttcggccgctgcccgaaatgcggcaaaggcaagctctttcgcgcctttctgaagaccgccgacaactgttcggaatgcgggctcgatttttccccgcaccgcgccgacgacctgcccgcctatctcgttatcgtcgtcgtcggccacatcgtgataccgctggcgctgctgatcgagaaagggttttcgccaccgctcgtcgttcagtgggcaatttatctgccgacgacgctggtattggcgctatggctgattcagccgatcaagggcggggtggtcggcctccaatgggcccttcgtatgcacggtttcgacgagaattttgtcgaagatcaaatctga

SEQ ID NO: 7326 - DNA, 438 bp, Mesorhizobium BNC1
atgatggaagaacaggttttcggcggcggcgcccatgcgaaacagcacgatcggtctgttgtccgcgccatgtggcgcgggttccagggcaaatgcccccattgcggcaaggggcgcctcttccgctccttcctcaagacggtggatcgctgctccgaatgcggcgaggagatgatccaccaccgtgcggacgacctgccagcctatctggtgatcgtcatcgtcggtcatgtggtcgtgggggcattcatgggtgtcgaggcggcgaccgaatggccgctttggctgcatctcgccatttgggcgccgatcaccgtcatcatgtcgctgctgttgctcggccccgtcaagggtgccgttgtcggcctgcaatgggccttgagaatgcacggcttcggcgaagagaaggaaattctcgaaacaaagcccgaaatctag

SEQ ID NO: 7327 - DNA, 456 bp, Bradyrhizobium BTAi1
atgagttcaacgccccgcgcattgccacaggccttgccacagacttggacgcgtgacgccggcgccgtcgagaagcgtgacgtctggacggcgatgaagcgcggcctgcgcggccgctgcccccgctgcggcgagggcagactgttccgcgccttcctgaaggtcgccgacgcctgcgatcgctgcggccaggatttttccggccatcgcgccgacgacctgcccgcctatctcgtgatcgtcatcgtcggccacatcgtcgtgccgctggctctgtcgatcgagaccaactacgcgccgccggtggcgctgcagctcgcgatctatctgccggtgaccttgatcgcctcgctcgcgctgctgcaaccggtcaagggcgccgtcgtcgggctgcaatgggcgttccgcatgcacggcttcgacgacaatccggtggaaggcattccgccggtctga

SEQ ID NO: 7328 - DNA, 462 bp, Brucella ovis; identical to SEQ ID NO: 7320

SEQ ID NO: 7329 - DNA, 456 bp, Sinorhizobium medicae WSM419
atgaaggcaaccgcgacagacatgcttcagcttggcggagcgcagggcgacgaacggccggtcggccggtcgatcaagcgtggccttttcgggacttgcccggcctgcggccgtggccggctgtttcgcagctttctcaaatcggtggaggcttgcgacgcctgcggcgagcgcatggatcatcaccgggccgatgacttcccaccctatatcgtcgtcacgatcgtcggccatgtcgtacttggcggctacatgatgaccgatctcgtgctgccgctttcgacgtggcagcatctcgcaatctgggcgccggtgacgcttgccagttcgcttgccctcatgcagccggtcaagggcgcagtcatcggactgcaatgggccttgagaatgcacggcttcggcggtcatgacgacgggcccgaagacattctgcctccgcgagaaacttcggcatga

SEQ ID NO: 7330 - DNA, 462 bp, Ochrobactrum anthropi ATCC 49188
atgagcacgctagaggccaattccgcgcagaatgttcaggttttcggtggcgaaagccccaaggccgctcacccgaaacgccctttgggtgaagctatgtggcgcggctttcgcggacgttgcccgcattgtggtgaaggaaagcttttccggtcgtttgtgaagccagtggcgcagtgttccgtgtgtggcgaagactacacggaacaacgtgccgacgaccttcctgcatacctcaccattctgatcgtggggcacgtggttgtaggcgctttcatgggtgtggaagcaaccaccaatctgccactctgggctcatatggcgatctggggaccgttgactgtgatcatgtcgctgctgctgcttcaacctatgaagggagcgaccatcggcctgcaatgggcgctctacatgcatggtttcggaggtaagggcgaaggtgaatatggcgacgtgacctga

SEQ ID NO: 7331 - DNA, 426 bp, Parvibaculum lavamentivorans DS-1
atgagtatcccgatggacatgtccgagcctcacatctacgagacggccgagatctctccccgcccggccttcccggcgatccttcgcggcttcggcggccattgcccggcctgtggcaccggcagcctcttccgccgtttcctgaaagtgacggacagctgcgcccattgcggcgaggaactccatcaccacgaagcggacgacgccccgccctatttcaccatcatgatcgtcggccacatcgtcgtgccgctcatgctctgggtggagctggcctatctcccgccgctctggattcacgccctggtctggcccgcgctcaccctcgtcctttcgctctggctcctgccccgcgtcaagggctccgtcgtcggctggcaatgggcgctccgcatgcacggcttcgacggcgtgacccgcgactga

SEQ ID NO: 7332 - DNA, 546 bp, Xanthobacter autotrophicus Py2
gtggacacgcctgcgaccatgacggtaacgacaaccctcgccggctccgagccgggggaggcgcgggaccgtgcgccgcaagagccgcctgcccggcccaatggcccgcctcctgcccgcacccgcgccgttcccgaggcgctgctgcgcggcgcacgcggccgttgccccgcctgcggccgcgggcgcctgttctccagctatctcaaggtctcgccctattgcccggactgcggcgaggagctgtaccaccaccgcgccgacgatgccccgccctatgccaccatcctgctggtggggcacatcgtggtgccgctgatggtgctggtggaggaaatctaccgccccgaggtgtgggtgcacctcatattgtggctgccgctgacgctggcgctgtgcctcatcctgctgccgccgctgaagggcatgctggtgagcctgcaatgggcgctgcgcatgcacggcttcgacccgcaaagccccgagcgggaaggtccgcccgacggggtggtgcccgtggtgcgcgccgtccggcccgtccgctga

SEQ ID NO: 7333 - DNA, 498 bp, Methylobacterium extorquens PA1
atggaaacctacgcctcccctccggccccggctccccaggagcggacgcggctgctcccggccatggccaacggcttcctcaaccgctgcccgcattgcggcgagggccacgtcttcggccgcttcctcaaggtgcggccggcttgcgaggcctgcggcctggagatggagggccaccgggccgacgacctgccgccctatatcgtgatcttcctcgtgggccacatcatcggctacctcgtgctcgagatcgagatgggctacgacgtgccgctctggatttcgatgacggtgtggccgctgctcaccctcgtcctggcgctggtgctgttgcagccggtcaagggcgcggtgattggcctgcaatacacgttcggcatgcacggtttcggcaagttgccccccgcgcgcggtgggaccggcacgggcacgggggagagacgcggcggtgaggcaggaagcagagcaggcgacgccccaaagcttggatcagcctga

SEQ ID NO: 7334 - DNA, 465 bp, Methylobacterium radiotolerans JCM 2831
atggccgccgacgcgatacccgagcgcacccgcctgatccccgcgatggcccggggcttcatcggccgctgcccgcattgcggccagggccggatcttcgggcgcttcctcaaggtgcggccggaatgcgacgtctgcggcctggagctgcaccaccaccgggccgacgacctgccgccctacgtggtgatcttcatcgtcgcccacatcgtcggctacctgatcctcgagactgagagcgcctacgacgtgccgctctgggtcgagatgggcgtctggccggtcttcaccctggtcttcgcgctggtcctgctccagcccgtgaagggctccgtcgtcgggctgcaatacgcccttggcatgcacggcttcgccacgctaccgcggagccgccccgccccgggaccggaggagacacgccttgccgctgccgcagcaggagccccagatcgccacagctcctga

SEQ ID NO: 7335 - DNA, 438 bp, Methylobacterium populi BJ001
atgccggccatggctcgcggcttcctcaaccgctgcccgcattgcggggagggccatgtgttcgggcgcttcctgaaggtgcgtccggcctgcgaggcctgcggcctggagatggagggccatcgggccgacgacctaccgccctatctcgtgatcttcctcgtgggccacatcgtcggctatctcgtgctcgagatcgagatgggctacgacgtgccgctctggatctcgctgaccgtttggccgctgctcaccctggtcctggcgctggggctgctgcagccggtcaagggcgcggtgatcggcctgcaatacacgttcggcatgcacggcttcggcaaggcgccccctgcgcgcggcgggaccggcacgggggagagacgcggcggtgaggcaggacgacgagcaggcgacgccccaggactcggttcggtctga

SEQ ID NO: 7336 - DNA, 429 bp, Rhodopseudomonas palustris TIE 1
atgaccacgctgtcacgcgagccgatcgtctggcctccgcaatccgccccgtcgcagcagcgcaacgtctggcaggcgatgtggcgtggcttccgcggccgctgcccgaactgcggcgaaggccggatatttcgcgcgttcctcaagaccgccgacagctgcgaccgatgcggccaggacttcactggccatcgcgccgatgacctccccgcttatctcgtgatcgtcatcgtcggccatatcgtggtgccgatcgcgctgtcgatcgagacgcattacgccccgccggtggaattgcagctcgcgatctacctgcctttcaccctgctggcttcgctgctattgctgcagccggtcaaaggcgccgtcgtcggattgcaatgggcattccggatgcatggcttcgacgagaccaacccggacgactga

SEQ ID NO: 7337 - DNA, 513 bp, Methylobacterium sp. 4-46
gtgatcgagatcgacgggcgggacgcccccgcgcagcccccagccgaggtgccctggcacctcgcgatgctgcggggctttcgcaaccgctgcccccattgcggcgagggccgcctgttcgggcgcttcctgaaggtgcgcgaggcctgcgaggcctgcggcaccgaactccaccatcaccgggccgacgacctgccgccctacctggtgatcttcatcgtcggccacgtggtcgggctcgccatcctggagagccagatgcgcctcgacgaattgccgctctggttcgagctgaccttctggcccgccgtgaccctgatcatggcgctcgccctgctgcagcccgtgaagggcgcggtcgtcgggctgcaatacgcccttggcatgcacggcttctccgcgatacgccgcgcacgcaccgggaccggacagggcggggaggcacgggatggcgcgcgcgacggcggggacgatcgagagcggggccgcgcccccggcctccgcggcgcctga

SEQ ID NO: 7338 - DNA, 453 bp, Rhizobium leguminosarum bv  trifolii WSM2304
atgagcacaccgaccgaaccggtcgtccgctacggcgacaggcccgaggccgaacgtccgctgggacgctccatcctgcgcgggctgatgaaccgctgcccggcctgcggcagcggcaaacttttccgcgccttcctgaagccggtcgatcattgcgcggcctgcggcgaggcgatgcatcaccaacgcgccgacgacctgccgccctatatcgtcatcctcgttctcggccatgtcgtggtcggcggctacatgctgaccgacctgaccttcgtgctgccggtctgggcccatatcgccatctgggcgccaatcaccgtcatcaccgcgcttgcctcgatccagccgatcaagggcggcgtcatcggcttgcaatgggcgctgcgcatgcacggtttcggcggcgagagcgacggtccggacgattatgacatccccggacgcccggattga

SEQ ID NO: 7339 - DNA, 498 bp, Methylobacterium chloromethanicum CM4
atggaaacctacgcctcccctccggccccggctccccaggagcggacgcggctgctcccggccatggccaacggcttcctcaaccgctgcccgcattgcggcgagggccacgtcttcggccgcttcctcaaggtgcgcccggcctgcgaggcctgcggcctcgagatggagggccaccgggccgacgacctgccgccctatatcgtgatcttcctcgtgggccacatcatcggctacctcgtgctcgagatcgagatgggctacgacgtgccgctctggatttcaatgacggtgtggccgctgctcaccctcgtcctcgcgctggtgctgttgcagccggtcaagggcgcggtgattggcctgcaatacacgttcggcatgcacggtttcggcaagttgccccccgcgcgcggtgggaccggcacgggcacgggggagagacgcggcggtgaggcaggaagcagagcaggcgacgccccaaagcttggatcagcctga

SEQ ID NO: 7340 - DNA, 516 bp, Methylobacterium nodulans ORS 2060
atgatcgagatcgacggcagggccacccctgcggcgatgcccacggaggaggtgccctggtacctcgccatggcgcggggttttcgcaatcgctgcccgcattgcgggcagggccgcgtcttcggacgcttcctcaaggtacgcgacgcctgcgagtcctgcggcaccgagctgcatcatcaccgggccgatgacctgccgccctatctggtgatcttcatcgtcggccacctcatcggcctcgggatcctggaaagccagatgcgcttcgaggacatcccgctctggttcgagctcgccttctggccggccgcgaccctggccctagcgctcgccctgctccagcccgtgaagggcgcggtggtcgggctgcaatacggtcttggcatgcatggctttgccgcgatacgccgcaggcgggccgagacgagcccgggcggggagacacgggatggcgcgcgcgacggccgggacgatggacagcggggccatgcccccgatctccgccgcgcgtga

SEQ ID NO: 7341 - DNA, 456 bp, Agrobacterium vitis S4
atgtctgtcagccagtctccccccgttatccgcttcggcggcggcaaggatgcggttcgcccccttggacgctccatcctgcgcggtctgatgtgtacctgtccggcctgcggctccggtcgcctgttcaaggccttcctgaagccggtcgatacctgcgcagcctgcggcgaggatctttcccatcagagggccgacgacctgccgccctatatcgtcatcatgatcgtcggccatgtgctgctgggcggctatatgatgaccgatctggtcttcgtgctgtcaacctgggcgcatctggcgatctggacaccgattgccgtcatcgtctctctgttgatcatccagcccatcaagggcggcgtggtcgggctgcaatgggcgctgcgcatgcatggtttcggggacgagtctgaggtgatcgaggactacgacgagcgctatccgccaaagtga

SEQ ID NO: 7342 - DNA, 456 bp, Rhizobium leguminosarum bv  trifolii WSM1325
atgagcacaccgaccgatccggccgccgcccgctacggcgatacgcccgaggtcgagcgtccgcttgggcgctccatcatgcgcgggctgatgaaccgctgcccggcctgcggcaacggcaaactctttcgcgccttcctgaagccggtcgatcattgcgccgcttgtggcgaggcgatgcatcaccaacgcgccgacgatctgccgccctatatcgtcatcctcgtcctcggccacgtcgtggtcggcggctatatgctgaccgacctgactttcgtgctgccggtctgggtccatctggccatctgggcgccgatcaccgtcatcaccgcgcttgcctcgatccagccgatcaaaggcggggtcatcggtctgcaatgggcgctgcgcatgcacggcttcggcggcgagagtgatggtccggacgattatgacatccccggccggccgaattag

SEQ ID NO: 7343 - DNA, 558 bp, Trichodesmium erythraeum IMS101
atgtgttggggtaaacttttacaaccagatttagttctgggtaactcagtcttaagtctaacattagaaattctccaaaaatatcaaattcaaggtttggtgttagatgtagatgagactattgtgccaattcaccatagtcaagcttctcctgaattagctgtgtgggtagaaaaaattaaaagtgtagcaagtttatggttagtcagtaataatcttagtcaagatagaataggtcgaattggtgatttactcaatataccttatattactgctgctgggaaaccttctcgtcgtaagttaaaaaaggctgttgatgcgatgaatttaccagtagaaaaagttgctatggtaggcgatcgcttgtttactgatgttttagcaggaaatcgtttaggaatgtttactattcttgttgaacctatatctagtaatggtttagaattttctaactataaagttcgttcttttgaagtatgggtttctcaaatattaggagtatctttgaatttgactactcactctttgatttatgatcataaaaatgattttatgtaa

SEQ ID NO: 7344 - DNA, 522 bp, Dictyoglomus turgidum DSM 6724
atgttggatatattaaaacctaaaagatttgttgactccatatttgatatcaatttcgaagatttatataaaaggggctatagaggtataatttttgatcttgacaatactatagttccatgggatggtaatgaactcgatcctaaaactaaggatctaattgatcatattaaaaatataggttttaaagtggttattttgtcaaataactggtctcatagaagggtaaaatatttttcaaaaattatgaaactacctgctttaggctctgctttcaagccgagagttagatcttttaaaaaagccatgaagttgatggatacagaacctgagaccactttagttattggtgatagaatattaacagatatatttggaggtaacaaaattggaatgtatactatattagtagcacctattaataaaaacgagatgtggataaaaaagtggacagtaaggaaattagaaaattggctcttagatttatggattagaagaggagaaattactaagggggaatga

SEQ ID NO: 7345 - DNA, 531 bp, Cyanothece PCC 7425
atgactgctggttctcctgcctttttgctgcaacccaatctggttttgcccggcaccattctcaagctcaccccagagatactccaccgtcatgagttgcaggggttgatcctggatgtggacgataccctcgttcccccctggaatgcagaagtttccctggaggtgctggaatggctggctgagatcaaacgggaagtggatttgtggctcgttagcaataacctaaattaccgccgcatcagtcgcattgcggaagcgatgaatttaccctatttgttgggggcaggtaaaccttcgcggcgcaagattcgacaggcagctctggccatgaatttaccctttgcccaggtggggatggtaggcgatcggctgttcaccgatgtcctggcaggtaaccggctgggcttgtttacgattctggtcgagccgattctcgatccggcggatattgcccgttccgctcccctgcgctcatttgagatctgggtgtcagaaaaattgggggcaaccctgacggcggcggaatag

SEQ ID NO: 7346 - DNA, 561 bp, Eggerthella lenta DSM 2243
atggcttttctcgaacccgaccgctactttgcgcgcatctcgcgcatcgatatcgaccgcgacctgctggcgctggactttcgcaacgtgctgctggacgtggacaacaccatcctcacgcgtgacacccacgaagtgccgcgcgatgtggggttctggctggcgaaggcgcgcgatgcgggcattacgttctgccttgtgtccaacaactggcacgaaggggtgtaccagctggcgaaccgtctttcgctgcccatcgtggcgaaggccgtcaagccgttgccgcccgcgttcctcatggctttgcgcaagctgggagcgaagcgttccgagacggtggtcatcggcgatcagctggtcaccgacgtcatgggcgcgcattttctgggcatgaaggcgtatctgctggctccgctggtggagcaggatctgccccatacgctgctgctgcgcaacttcgagcgcgtcgtcatgggcgagcgtaagccggagggcgccgcatcgacgtcgcagaacgccgtcccctgcgaggatgaggaacccgacgcgcagggcgtctga

SEQ ID NO: 7347 - DNA, 591 bp, Cryptobacterium curtum DSM 15641
atgaaactcctttcacctgagcgctatttctcgcgtatatctgacattgatatacctcacgatcttcttgacgtgggcatttcgcatgtactgctcgactttgataacaccattttgtcgcgcgcaactcatgatattccgcctgatgccttgcgctggattgaacaggcaaaacaggcaggtatcaccctctgtattgtgtcaaacaactggcatgcgagcccgtttgatgtggctcgtacgttggatatagcggtagtggcaaaggcgtgtaaacctctgccattcggcttgttggtagcacgcggaaaagtaggggcacggagcaacaatgcagtggtagtgggtgatcagttatctaccgatgtgttaggtgctcatctgctgggcatgcgtgcttggcttgtttgtccgcttgctgaagaggacttgaagcatacggttgcattgcgtcgtttggaacgttccctgattggtagtcgtttgccggagggagcgcccgcttgtgaagggtcgtccttcgcagttgattactcgctgcattcagatagtttgcagccatcaggtaccaaagggggtacggcgcaatga

SEQ ID NO: 7348 - DNA, 498 bp, Slackia heliotrinireducens DSM 20476
atggcccttttgcgacctgaccggtacttcaccagggtatctctcatagacccgcaagccgacctgctcgaccggggcattcgcttcgtgctgctcgacatggacaacacgcttttgccccgtgacacccacgaggtgccgtcggacatcctcgcttggctggctgatttgtcgaagtgcggcgtcggtgctctgattctgtcgaacaactggcatgagagtcccttcgaatgggggaggcgcctgggtctgcccgtggtggcgaaggcctgcaagccgctgcccatcgcctatgggcgcgcgctccgcactttaggggccacgcgcgccgagaccgtctgcatcggcgaccagctgatgaccgatatctggggcgggcactttgccgggttcgcgtcgtatctggtcgatcccctgacgacggtggacctcaagcacaccttggtcctacgtaaattggagcgcaaaatcatcggtggcatgccgcctgagaagtag

SEQ ID NO: 7349 - DNA, 498 bp, Atopobium parvulum DSM 20469
atgagtctgatcaaagcaacacaatacgtttctgctgttgaacatatctcggtagagagccttgttcagcgagggattaagcttgtgctcctagatcgtgataatacctgtgtacctcgagatactaaagttgtgccatcagaggtgtccgcttggtttgaaaaggcccatgcagctggtcttatgctttgtcttgtctctaacaacatccattttgatgaggtccagcgcagcgctcatgaactgggaattgaaggagagggctttgcttgcaagccgcttcctcgtgcattaaatgctgctatgaagcgtttttcggtaacaaaagaacaaacagtaatggtaggagaccagatttttaccgatattattgcaggtaatttagccggtgtatcaactattttggtaaaaccgcagtctactgaggatttgtggtacaccaatctcattcgtcacgtagagcgccgcattttaaaaaatgtaacttttacgtcataa

SEQ ID NO: 7350 - DNA, 582 bp, Moorella thermoacetica ATCC 39073
ttgttttaccagtttgccaaatttgtctgctacttatttctccgctttatatgccgctgggaagtccggggccaggaaaacataccggccgaagggccggtggttatcgtcgcaaatcatgtctcctacctggacccggtggtagtcggcgttgcctttccgcgaatggtacgtttcatggccaaagaggagcttttccatatccccatcttcaagtacattataaggggcctgcaggcgttccctgttcgccggggcgagtcggaccgtgcggccttgaaaaccgccctgcagattcttcaccagggccaggtcctgggtatatttcccgaaggcacccgcagtcctgacggccgcttacttcccttccaggccggggcggcggtactggcccttaaaaccggggccgtactcctgccggtggccattaaagataccgaccgggtctttcgcggcggccacatcaagataacctttggccgtcccctgaaaataacaacctccgggagaaactacacttcccagcaagttcaggacctgacgtcagccgcctaccaggaagtaaagaaaatgctggcttaa

SEQ ID NO: 7351 - DNA, 594 bp, Syntrophomonas wolfei Goettingen
atgttatattcgtttctcagggctattcttcaagttctttttttcctgttgggtttgaaagcagaaggattacacaatatagcagaaaaaggtccgttaatactggcggccaaccatgttagttattgggatcctatagtggtggccatcgcggtaaaacggccaattaattttatggccaaagccgaattgtttgaccatcacttgctgggtttttttgtaaaaagactcaacgcatttccggttagaagaggcttggctgacagaaatgccataaaaaaggccctgttgttcctggaagagggaaaaatcctgggtatattccccgaagggatgagaaacttaaaggaagaagatttgaaggctcaggcgggagtagctatgatagcccttaaatccggagctccagtagtgcctgtggcctgtgtaggcactaataggatattacccctgggatggttccgccctctaaaggttagagtaggcgatcctattggccttgaagaatatcaggggcaaaaagttaattcggcagttatggaaaagctgagcagtgagattatgactaaaataaatcttcttttacaaaaataa

SEQ ID NO: 7352 - DNA, 612 bp, Clostridium thermocellum ATCC 27405
atgtatgctagtttgaagaatatatactatggttttctgagggcaattattactacgttttttgacttgttttacagggtgagtattatcggtatagaaaacgttccggtagaaggtcctgtacttttgtgtgcaaatcacattgctgaaatggatatgttttttataggatacaggctgaaaagactggttagatacatggccaaggaagaactcttcagaattcccttagtatcttcatttataaaaagccttggcgcttttcctgtaaagaggggaaaaggagatgtcggagcaatcaaaaccgctttgaaactccttgaggaaggtcatattgtcggtatttttcccgagggcacaaggcttaaaaataaaaaaggcaaaaatataaaagccaaacccggggccgcacttttggcacagaaatcaggtgctccgattttgcctgtggcaatttcaggacgttaccgtcctttcagtaaaataaaagttgtttttgggaaaccatttactcttgatttagacaaaaatacgaaatatactaatagtgaattggttgaattcagtgaaagtataatgaaaaaagtttattcacttttgggggagtattaa

SEQ ID NO: 7353 - DNA, 585 bp, Desulfotomaculum reducens MI-1
atgctttatactactctcaggtttatcattcgttacatccttttaatatggagaagatggaagattgtaggccgtgataatttgcctgtaagcgggggagttctggttgtttcaaaccacgttagcaacttggaccctttggtagtgggatgtgccttaactaggcgcattcattttatggccaaggtggaattgtttaaaattcctattttagctagccttatacgaatgttaggggctttcccggtcaatcgtgaaagatcagatcgtaaggccattcgtatggccttagaatatctgcaaaacggtgaagttgtcggaatatttcccgaaggaacccgtagtaaaaccggagaattgcaaaaggcccaaatcggtgcagcgatgctggctgttaagagcaatacccctatccttccagttgctctcataggaaccaggggaatctttaataaagttgtagtgaagattggtgaacccttatatatacccgaactgtggcgaagccgtgccagtaaagagcaactagaagcactaagcgaacaggttatgaaggaaattgaacgattaattaacaatcagtaa

SEQ ID NO: 7354 - DNA, 582 bp, Candidatus Desulforudis audaxviator MP104C
gtgttttactggttctgctggcacctgtgccgaaccgtgctcctggtactgcggcgctgggaggtaaaaggagctgaaaacctgcccgtttcgggcgggctgattctcgccgctaaccatagtagttactgggatccggtggtgtgcgggtgtgtgatgaaccggcggatctattttatggcgaaggccgagcttttccggatccccgtgctcaggacgatcatcacggcctggggggcattcccggtacaccgagagacggtggacagggaggcgattcgcacggcactggctcacctcaaggcgggacgggtggtgggtatgtttccggagggaacccggagcaagagcggtgagcttcaaaagcctcactacggggcggcgctggtggctttgaagggaggtgtccccatactgccggttgccctgatcggcaccaaaggcgtttttggcaaagtccgggtgcggatcggaaaaccgctccactttccggaatacgccggaaacaagccctcaaaagaggtccttgaggagatgagcaaccgggttatgggagaaatcggtaccctgctcaaggcgtga

SEQ ID NO: 7355 - DNA, 588 bp, Natranaerobius thermophilus JW NM WN LF
atggaaaataaaagaacttcattgtatatagtacttcgctttttatttagactattatttaaagttgtttatccaattaaacttgaaggtaaacaaaatctacctcacaatggtccggctattatttgctctaatcatatatcacttctcgatccgattttactaggatgtatatctgaacctcatgtaacttttatggctaaagaagaattatttaacatccctgtgattggaaggataatttacttattaggcgctttacctgtaaaaagaggacaagttgataggaatgctataaaattatctttgaaacagttatcaaaaaattgtgtttttggtattttccccgagggaacaagacatagtgaagacaaaaaacctttaaaaggtgtaggatttctagcggctagaagtaaagctcacgtagtaccagttactataataggtccttatagattgtttcgaaaaactcgtgtagttgttcatcaacctgtcaattatgatgaactagattttgcaaaatcggaggatccactgctaggttttagtcagtatataatggacacaattaacagtgaattaaattag

SEQ ID NO: 7356 - DNA, 588 bp, Elusimicrobium minutum Pei191
atgcttcttaatttgataaaatttactttcagatggttcttgataattttttataacgcgaaagtcgaaggtttggaaaatattcccaaaacaggccggcttataatagtaagcaatcaccgctctaatgtagatccgccgcttttaggcggtttcgccgggttggtaagggattcgaggtacgttataaaaaaacagcttatgagtttacctttattgggcaggttgtttaagtcatacgggtttattccggtagaccgtcaggccggcaaagacatgggcgcttttaaggctattatgtcctcgcttaagaaagaagaaagcgtagtcatttttcccgaaggcaccagatcaaaaaccggtaagcctttaaaaccgaaagcgggcgtaagttttgtggctcataaaacaaattcgccagttttaatatgcagggtttttaatacgtttggttttccctgggtaagaaatttacgtgtggtatattcacacacaatcaaatttgaagaagtggaaggtgttgatcttaaagttcaataccagcagtttgcagataaaataatgtcggaaattgaaaaagttaaataa

SEQ ID NO: 7357 - DNA, 591 bp, Desulfitobacterium hafniense DCB 2
atgaacctatatcagtttcttaaaaggatattccgcctccagtttcgagtgatgggctggaaaatccatggtgttgagaatctccccaaggagggaccggtgatcatagtcagcaaccatgtcagcatctgggatcccgtggtagctgcctgcagtgttccccgggatgtttcctttatggctaaggaagaactattcgccaacccccttttgggggggatttttcgcagattgggagcattccccgtcaagcggggacaaggagataccagcgcgattcgcaattccctgaaggttcttaaggaggagaaagttctgggactttttcccgaaggaacccgctctaaaaccggtgcaatacaaaaggggtttcccgggatgattttgttgatggaaaaaagccaggctcccatcgtgcctgtgcgggtcaatggaactcaaaatctttttgtgcggggatggggacacctggaagtcattgtgggaaaaccgatctttcctgaacagctcaaagcgcctgaaggggttgagaaccgcagagagtgggctgccgaccaaatcatgaaggccattgtggaattaaaagcctag

SEQ ID NO: 7358 - DNA, 582 bp, Geobacillus WCH70
gtggatttttattcgtttgccaagggagttgtaaaaagcattttaacccctctttaccgtattgaggtgataggggcggagaagtttccgaaagaaggaggagtacttctttgcgcaaaccatattagcaatctcgatccgccaatccttggaattactgctccaagaccgattcattttatggcgaaagaggaattgtttcgtgttccgctcttaaaaaacttaattacgactttgcatgcgtttccggtaaaaagaggaatgagcgatcgccaagcattgcgaaccggcttagaagtgttaaaacaagggcatgtgttaggcattttcccagagggaacacgaagcaaagatggaaaattaaaaaaagggctgcctggcgtcggtttttttgcgcttcgaacaagtgccgctgttgttccatgcgccattattggttcatatcgtccgtttgtgccgcttaaggttgtttacggatcaccgattgatatgacgccactaagagagaaaaaagcatcaccggaagaagcgacagcttatattatgcaacatatccaagcgttattagatcagtatcgataa

SEQ ID NO: 7359 - DNA, 603 bp, Anaerococcus prevotii DSM 20548
atgttatataattttttagtagtgcttttaaaaatcatatgctttcctatttttagaataaaggttaagggtcttgaaaatatcgaagaaactgataaagttatcgtatgcgccaaccataagtctttgttggatccgatatttttagcaataagtttacctcaaagaatctattttatggcgaaaaaagaactttttgataagccttttgtaggtggatttctaaaagctcttggagcctttccagtagatagatttgggcgtgacttaaaagctttgagggcttcagtagctttggtcaatgaaggaaagattctcggaatttttcctgaaggaactagggttaaggaagttaagagagaaaatgttaaagatggtgtggcatttgtcgccttaaaagctaaggcagatattatgccagtagagataatttctacttacaaaccatttaggaaaagtgaaattttgataaaaaaacctatagctgttagtgaattcgcttctctaaagaacaaagaagctatgaagaagatgacagatagggtttatgataaaatctatgagcatcacacaattgtggaaagtgagaatcaatggaaataa

SEQ ID NO: 7360 - DNA, 585 bp, Desulfotomaculum acetoxidans DSM 771
atgatttatcaaaccagtaaatttctctgtactgctgttttaaaaattttacgccgctggcaaatacaaggtttaggtaatttacccgctaaaggaggctttctgatagtatccaatcatacaagttattgggaccctctcgccgttggttgcgctatcaagcctagaatatactacatggccaaagctgagttgtttaagataccggtatttagagaattgatcacgtcttttggagcttttccggtacacagggaaaaagccgatcgtcaagctattcgtatggccttaaaattgcttaaagaaggcaaggtggtgggaatttttcccgaggggacaagaagtcattccggagaattattgcagccgcatttaggtgcggctatgctggccttaaaatcccaggtaccggtcgtgccggtagcggttttagactccaagggtatatttcgcaggcttaaacttaatataggcaagccattttatataggaaaccggcaatcagatcaaacgccaaaagaaattattgaggccggaactgaacaaatcatgtctgaaatttctcatttaatgcaattaaaataa

SEQ ID NO: 7361 - DNA, 603 bp, Alicyclobacillus acidocaldarius DSM 446
atgtccggtgaatccagcgatttgccccgtacgctcttttaccgcttcgcgcgggccgtcgtcactgcgttttttcgcacgtgttttcgcgttcgggtggagggcttggagcggctcccgcgtcagggaggcgtgatccttgcgtcgaatcacctttcgaatttcgatcctccgcttctagggattctggtcccgcgatacatacgtttcatgggcaaggccgaactgtttcgcatccccgtgcttcggcgcatgttcctttcacttggggggtttcccatcgagcgtggccgcgtggaccggcgcgcgatccgcacggcgatcgaagttctgcaaggcggaacttgccttgtcatgttccctgaagggcaccggtcgcgaacgggcaaactcgggccgctgcagcccggaatcgcgtccatcgccagaaaagcgggcgcgatcattcagcctgtgggtatccgggggcggtaccgtatgttcgggcgcatcgaggtgaggttcggagatcccatcgacgtgcgggaatggtcggatgaggagatcatgcgaaatctccgagaccagctgcttctgctgaccggtcaggaggaatcgcgctga

SEQ ID NO: 7362 - DNA, 660 bp, Desulfovibrio desulfuricans G20
gtggctgaacacatcattgtcacactggacggccccgccggagtgggtaaaaccacactggcccgcaatatagccgaagagctgggcatagcgtatatggataccggagccatgttccgcagtataggctggaaactgggcaatgtggtggaatcagtgccacctgccgaaatagaaaagaaacttgccggattccgcttttcattatccggagccggggctgccacgcagctttcgctcaacggcacacccgtgggggatgaaatccgcaccgaagaagttgccctgctggcctctgccgtggcaacgctgccagtggtccgcacctttctgaaaaaaacccagcagaaactcggcagtgaagtttctctggtggcggaaggacgcgacatgggaaccgtcatctttcccgcagccagatacaaattttttctggatgccacgcccgaagaacgggcacgccgccggtacgagcagctcacggctgccggtgagacaccggacctgaaggccctgacggaccagatacgcaaacgcgaccatcaggaccgcagccgggtggtcgcaccgctgcgccccgcagacgacgccataattattgatacaaccgaactggatgtgcagggagtttttgcagccataatgagcaaactcaaataa

SEQ ID NO: 7363 - DNA, 678 bp, Syntrophobacter fumaroxidans MPOB
ttgaacaacgcgacgatcattgccatcgacggccccgcgggagccggcaagagcaccgtgagcagactgctcgcaaaggaattggggtacacctaccttgattcgggcgcgatgtaccgggccttggcctgggcactgcagcgggagggcgtcgacctggaggcggaggcgcacgttgcgcgggccctgcccgagctgccgttggagttttccacccgcggcggttcgctcctgatccattgcggtgggaaagccctggaagacgagttgcgcaatcccgaaatggccgcgtacgcgtcccgcatttcccaaatgcgtgccgtccggacgtttctgaccgaatggcagagaaagctcgccgaagcggggaaggtggttgcggaaggacgcgataccgccacggtcgtgtttccacacgccggggtcaaagtgtttctgaccgccgatcctgccgccagggccggaagaaggcatgcggaatacctcgcgaagggcatccgggtcgactatgcggtgctcgaacggcaaatccgcgagcgggacgaagccgacagcacccgctgcctggcgccgttgcgcccggccgacggagcggtgattctggacacctccgacctggatatttccgaggtgatgagccgtctgatggacttgatacgcgaaaagtcgcgcggctag

SEQ ID NO: 7364 - DNA, 699 bp, Desulfovibrio vulgaris DP4
atgcctgataccactgggggccacccggccgcactcaaggtggtgaccctcgacggccccgccggtgtgggcaagacgacgctggcacgccgcgtggcggatgccctcggcatcccgtatctcgacacgggggccatgttccgcaccatggcgtggagactcggccccgacggccccgatctggatgaagcactcctgcgcgaccgccttgccgggttcatcttcacgctacggggtcgtggcggggcatcggtactctcgtgcaacggtgaggacatcggcaacgagattcgcactgaagatgtgggggccatggcctcgcgcatcgccgcactgcccgtggtgcgcgaatgcctcaaggcagcgcagcagcgcatgggcgcagcgcagcccctggtcgtggaagggcgcgacatgggcactgtggtcttcccgggtgcacggcacaagttcttccttgatgccgcccccgaaatacgggccatgcgccggtacacacagttacagaccatgggcgaggcccacgaccttgcactcctcaccgaacagattcgcagcagggacgagcaagaccgcaacagggccgtcgccccactccgccccgccgccgacgccatcatcgtggacacgggggacctcgacatcgacggtgttttcggtgtcatcatgcagcacatcaggtcgcgcgacggactatag

SEQ ID NO: 7365 - DNA, 714 bp, Anaeromyxobacter sp. Fw109-5
gtgaccgccgggcggccgttcatcgtcgcgatcgacggccccgccggcgccggcaagtccaccgtctcgcgcagggtcgcctcgcgcctcggcttcgccatggtggacacgggcgcgatctaccgtaccgtcgcgctcgctgcgacgcggcgcgggatcgcgctcgacgacgacgcggcgctcgccgtgctcctgcccgagctggagatccgcttctcgccctcgcccggcggcggccagcgcgtgctcctcggcgaggacgacgtctcggtcgagatccgcacgccccccatctccctcggggcgagcaaggtgtcggcgaggccggtcgtgcgcgccgggctgctcgacctgcagcgccggctcgcctgcgcgcccgagaaccgtggcgcggtgctggagggtcgcgacatcggcaccgtggtgttcccggacgcggacgccaagttcttcctcaccgcctccgcggaggagcgcgcccggcgccggcacgccgagctcggcgcgcgcggggacgcctcgacgtacgacgaggtgctcgccgatcagctgaggcgcgacaaggacgactcggagcgggccatcgctccgctgcggccggccgcggacgcccagctcgtcgacacgagcggcctgccgctcgacgcggtggtggacgcgctggtgcgcgagctcgaggcgcggctctcgggcgacggacggagcgaggcgtga

SEQ ID NO: 7366 - DNA, 669 bp, Candidatus Desulfococcus oleovorans Hxd3
atgaagcctctgctgattaccatcgacggcccggccggcgccggtaaaacaacggtcagcaaggccctggcccggtgcctgggctatcggtacgtggataccggtgccctgtaccggggcgtggccctggccgccaaagaaaagggcgtggcccctgaggacgacgacgggctggagcggctgtgtacgggacttcggctgcgctttgtggtgaatgaggacgggtcgcggctgtttgacggggaccgggacatcagcggtctgatccgcacctcggaaatcagcatgctggcctcggccgtttcggcccggccggtggtgcggaaattcctgtttgaccttcagcgccgactgggagaagagaagaatgcggttttcgaaggccgggacatgggcacggtggtgtttcccgaggcggaggtgaagttttttctggatgcctctgttgaggagcgtgcccggcggcgctatgacgagcggtccgcggatgagacccgtaccctggaacagatcgccgaagagattcgcacccgggaccacaatgaccggacccgaagccacgcgcccctcaaacccgccaatgacgcgattttactggactccaccgcgatttccatcgaccaggttgtccaatccatgctgtcccgcataaaacaggtcgatttttga

SEQ ID NO: 7367 - DNA, 660 bp, Desulfovibrio vulgaris  Miyazaki F
gtggtcacgctggacggcccggcgggcgtgggcaagaccaccctggccaaacggctggccgacgcgctgggcgtggcctatctggataccggggccatgttccgcaccctggcctggaagctgggccccggtgcgcacgaactgccggaaggcgacctgcgcgcccggctggaaggcttctgctttgcgctgtccggcgcgggcggggcctccgtgctgtcctgcaacggcgtgcccgtgggcgaggaaatccgcaccgaggaagtggccgcgctggcctcacgcatcgccaccctgccggtggtgcgggaacggctgaaggccgcgcagcaggcgctaggggcctcgtgcgccctggtggtggaaggccgcgacatgggcaccgtggtgtttcccacggcgcgccacaagttctttctggacgccacgccagaggaacgcgcccgccgccgctgccagcaactggaagcgcagggccagcccgccgaccttgccaccattgccgcccagatccgcgagcgcgacgacatggaccgcaaccgcgccgtggccccgctgcgtgccgccgacgacgccgagacggtggacaccaccaccctggacatcgacggggtgttcgcggaactgacccggcacatcaccgcgcgcggcgggctgtag

SEQ ID NO: 7368 - DNA, 693 bp, Desulfovibrio desulfuricans ATCC 27774
atgagtgcgcgcctgcctgtggtgacgctggacggccctgccggagtaggcaaaaccaccctggcccgccgcatggctgaaagcctggggcttgcctatctggataccggggccatgtttcgctgcatggctctcaagctgggaccgggagcagaaaagctgccggaagaagaattgcgcgcccgctgcgcccactggaccttcagcctgggaggcatggggcagcagtctaccctgttctgcaacggcgtggctgtgcgcggcgaagtgcgcactgaagaagtggggatgctggccgcacgcatagccacagtgcctgtggtgcgcgatatcttacgccagacgcagcgcgccattggcgaaagttctgcccttgtagcagaaggccgggatatggggaccgtggtttttcccgatgcgcgcttcaagtttttccttgatgccgccccggaagtacgggccatgcgccgcctgcgcgatcttgaagaaagaggcgaagctgccgaactgacaagccttacggaacagatacgccagcgcgatgctctggaccgcaatcgcgccgtggctccgttgcgccccgctcccgatgccctcattgtagacacctcccatctggatatttcgggagtgctcggcgttatgctgcatcatatcagtgtgcatggcggaccgcagagcctgcgcggctag

SEQ ID NO: 7369 - DNA, 666 bp, Desulfomicrobium baculatum DSM 4028
gtggtcacgatcgtcactcttgatggaccggccggggtaggcaagaccactatcgcccgcgagctggcggaccgtttgggtatcgcctatctggacacgggagccatgttccgctccgtggcgctttatttcggggatggcgcctgggaacagcctgttgaccagctggtgcccgaactcaatcgtctcgattttgatctggaaggactgggaaaatattccgagctgctcctgaacgggatgcctctgtccccggaaatccgcaaggaagaggtcgggctgtgggcctcgcacctgggccgcattccggtggtgcgcgattttctgcgccgcaaccagcaggccatcggacggaccacctctctggtggccgagggccgggacatgggcagcgtgatctttccgaacgcccggcacaagttcttcatggacgcatccatcgacgtgcgcgccaaacgccgtcatgcgcaactcgcggccctgggcatgaacgaggacctggagcgcatccgcggccagatccgcatccgcgacgatcaggaccgcaatcgcgtggtggccccattgaagcccgccctggacgcagtgatcatcgataccagcgccctggacgcagaccgggtgctggagaagattgtggagcatatccgggaaaaaggcctctga

SEQ ID NO: 7370 - DNA, 702 bp, Desulfohalobium retbaense DSM 5692
atgcccgctaagcggccgttgatcgtgactctggacggaccggcaggtgccgggaaatccacagtggccaaggctgtggccgacgccttagaaatcgcctatcttgataccggggccatgtttcgcagcgtggcctgggcccttggtgcagattcctggcaaatggaccatgagagccttgtccgggccctcgaatcgatggaatttgatcttcacggccagggaccggcgtcctatttgaccttgaacggccagccgatgggcgcggatatccgtacggaaaccgtggggatgtgggcctcgcatatcgcacagctcctgccggtgcgagagaaactcaagcaggaccagcgtcgtctgggggcaaagcgggatcttgtggccgagggccgagacatgggtagcgtggtcttccctgaggcgtgctgcaagtttttccttgtcgccagcgctgaagagcgggcccggcggcggtgggagcaattacggcaaatgggacaagacccctcttatgagggattggtccagcagatccgtcagcgtgacgcccaggactcccagcgggaattcgctccgttgcgcgcggccgaggacgctatggagatcgatactacgacccgttcagcccaggaggtggtggagcgtatcgtggaactggtccaaagacggcgaaagggaactccgggaatgccgggggaatga

SEQ ID NO: 7371 - DNA, 408 bp, Ralstonia solanacearum
atgcgcacgaaaaccaccctatgcctgatgctgattggcggtgccgtcctggtggcctgcggtcagaaggaaaccgccgcgcccgcatccgctgcggtggcggcccaggtgcagagcggcacgccagccactgctgccgccgcaccggcccccgagaatgcgctgggcaaacgcacctacggcagtgtctgctccatgtgtcatgccgcaggcgtggccggtgcgcccaagccgggcgacaaggccgactgggggccgcgcgtcgcccagggcaaagacaccctttataagcacgcactggaaggcttcaacggcaacacgggcgcgatgccggcgcgcggcggctcgaccctgcctgacgacgccatcaaggccgcggtggactacatggtggcgcggtcgcagtga

SEQ ID NO: 7372 - DNA, 387 bp, Rhodoferax ferrireducens T118
atgaacaaacccaccctgctgctggcgacactgagcctggcctttttggccgcttgcggacaaaaagacgcccccgcacctgccacagcgccggcacctgtggctgcgcctgcacccgctccggtggccgagaacaccgtgggcaagtcggtctttggcagggtctgtgccatgtgccacgccgtgggtgcggctggtgcgcccaagccgggcgacaaagccgactggggtccgcgaatcgcccaaggcaatgacgttctttataagcacgcgcttgagggcttcaccggcgccaagggccagatgcccgcgcgcggggccaatgcgacgctgaccgatgacgaagtcaaggccgccgtcaattacatggcagatcaggcgcgctga

SEQ ID NO: 7373 - DNA, 414 bp, Cupriavidus metallidurans CH34 uid250
atgcgtatcaagaccctgttgctgacactgatttgcggcgctgctctggcggcctgcggacaaaaggaaagcgccgcacctgcgccggccgaggccaccgcggcaccagcaccggccgctgcgcccgcggctactgcggccaccaccagtgaacccgagaacgcgctgggcaagcgcacgtatggctcggtttgctcgatgtgccacgcggcaggcgtggccggcgcacccaagccaggcgacaaggccgactggggtccgcgcattgcccagggcaacgacacgctttacaagcacgcactggaaggcttcaccggcagcaagggatcgatgcccgcgcgcggtggctcgacaacgctgcaggatgacgccgtcaaggcagcggtggactacatgacggcacaatcccgctga

SEQ ID NO: 7374 - DNA, 480 bp, Acidovorax sp. JS42
atgcccttttggttttggacgtcaacaagaaaggctttcatgaaaaagacatctctcacgatggcgctggccgccgcaaccctgctgctcgccgcctgtggcaaaaacgacgctccggcgcccgcgcctgctcctgcacccgctgcgcaagcaccggctcccgcgcctacccctgctcccgcgccagccgctcaagcacctgccgccgcccccgcgacggcggagaacaccgtcggtaagagcgtgtacggcaaaacctgcgcgatgtgccatgcggccggcgttgcaggggctcccaagcctggcgataaggccgattgggcgccgcgtattgcccagggcaaggacacgctctacaagcacgccatcgaaggcttcaccggcagcaagggcatgatgcccgcgcgcggcggcgcggcttcgttgagcgacgacgaagtgaaggctgccgtggatttcatggctgaccagtcgatgtaa

SEQ ID NO: 7375 - DNA, 423 bp, Ralstonia pickettii 12J
atgcgcacgaaaaccaccctagggctgatgttgatttgcggtgccgttcttgcggcctgtggccagaaggaacccgccgcgcccgcggcctccaccgctgcggcacccgcgccggtacaaaccagcacaccccccgccgcaacgacggtggccgcagcagcggaaccggagaatgcgctgggtaagcgcacgttcgccaacgtctgctcgatgtgccacgccgcaggggttgccggggcaccaaagccgggcgacaaggccgactgggggccacgcatcgcacaaggtaaggacaccctttacaagcacgcactggagggcttcaacggcaacaagggggccatgcccgcacgcggtggatcgaccttgccggacgacgccatcaaggctgcggttgactacatggtggcgaagtcgcagtag

SEQ ID NO: 7376 - DNA, 480 bp, Diaphorobacter TPSY uid29975
atgcccttttggttttggacgtcaacaagaaaggctttcatgaaaaagacatctctcacgatggcgctggccgccgcaaccctgctgctcgccgcctgtggcaaaaacgacgctccggcgcccgcgcctgctcctgcacccgctgcgcaagcaccggctcccgcgcctacccctgctcccgcgccagccgctcaagcacctgccgccgcccccgcgacggcggagaacaccgtcggtaagagcgtgtacggcaaaacctgcgcgatgtgccatgcggccggcgttgcaggggctcccaagcctggcgataaggccgattgggcgccgcgtattgcccagggcaaggacacgctctacaagcacgccatcgaaggcttcaccggcagcaagggcatgatgcccgcgcgcggcggcgcggcttcgctgagcgacgatgaagtgaaggccgccgtggatttcatggctgaccagtcgatgtaa

SEQ ID NO: 7377 - DNA, 423 bp, Ralstonia pickettii 12D; identical to SEQ ID NO: 7375

SEQ ID NO: 7378 - DNA, 261 bp, Nitrobacter hamburgensis X14
atgaaaaagccatcgcggcagatcagggacgaaatcgcccggcttcaggagcaattgaagcaggctgaaacgcgggaggccgagaggatcggccgcgtcgcgctgaaggccggactgggcgagatcgagattgaagagaccatgctgctgtcggccttcgaggaggtagcgagcaggtttcgcaaaagcggcggccggacgtcgaaggcggccacgggcgtcgcatctggcgcgtctgcgggcgcgcctcaagagggctga

SEQ ID NO: 7379 - DNA, 297 bp, Sinorhizobium medicae WSM419
atgaagaaaccctcctcgaaaattcgcgaagagatcggcaagctccaggagcagttgaaacaggcggaaacccgcgaagccgagcgcatcggccgcattgcgctgaaggcaggactgggcgaaatcgagatcgacgagacagagcttcaggatgcgtttgagcatctcgcaagacgctttcggggagagcttgcggcttcgatcggaggcaggaagcgggttgaagacggcatacccagcacggcaacagcgacggtcgcgtctggcgcggctcagggcggccatggcgaggtttga

SEQ ID NO: 7380 - DNA, 363 bp, Methylobacterium radiotolerans JCM 2831
atggcaaggctgcaatcccgtaagacgatcctcaaggagatcgccgctctccaggagaaattgaaagagcacgacaaggcacaggccgagcggatcgggcgcctcgccctcaggtccggtctcgccacgctggatattcctgaagcctcgttgatggccgagttcgaaatcctggcgacgcgatttcgccagcaggccgctgccgagccacaacagaccggagaggagtcccaaggagaaggaagcgaagctgacgggatcggcgatcccggaagctcctcgacggacgcgagcgacgccgaggcagcgactgatccggcgcctgcggcggttggaaagacagctcgtgaacgcgcggcgtga

SEQ ID NO: 7381 - DNA, 279 bp, Methylobacterium chloromethanicum CM4
atggctcgatcgaagtcgcgcgagacgatcgtcaacgagatcacggcgcttcaggccaagctgagggcccatgacaaggccgaggccgaacggctcgggaatctcgcgatcaaatccggcattggcgcgatcgacatctcggacgacgaactggcccgcgagttccaggcgatcgtcgcccgatttcgtgagggggcatcgaaggtggaagagccaaaggcaaagggatctcgaggcgctggaaaagctccagagggagctgatgacgaagcggcatga

SEQ ID NO: 7382 - DNA, 297 bp, Agrobacterium vitis S4
atgaagaaaccatcgttgaagatcagggaagaaatcgccagattgcaggatcagctgagacaagccgaaacacgcgaggcggagcgcgtcggcaggatcgcgctgaaggccggcctcggtgagatcgagatcgaggaaaccgagctacaggctgcgttcgaagagatcaccgggcggtttcgcggaggcaaggcggcttcgactgggaagagaaatgctggtgacggcaggacagcaggtgagacggtcacgacgatcgagactggcgctgctgcgagcagcggtcgtgaggcttga

SEQ ID NO: 7383 - DNA, 378 bp, Agrobacterium vitis S4
ctgcacattcccattcatgacatccggaggaattctggcgtcgcgagtgcaacgccagaatctcaaggagaaccaaccggaatgaagaagccgtcatcgaagatcagggaagaaatcgccagattgcaggaccagctgaaacaggccgagacacgcgaggccgagcgcatcgggcggatcgcgctaaaggctgggcttggggaaatcgagatcgaggaggccgagcttcaggcagccttcgaggaagttgccaaacggtttcgcggaggcaagggctcggcgaccggaaagagacaagccggagacagccggaccggtagagagccgtccgcgacgctcgcgcctcgcgcggatgaaggcgggcctggcgaggcttga

SEQ ID NO: 7384 - DNA, 297 bp, Rhizobium leguminosarum bv  trifolii WSM1325
atgaagaaacactcctcgaaaatccgcgacgaaattgccaaactgcaagagcaacttaaaaccgccgagacccgcgaagcggagcggatcgggcggatcgcgctcaaggctggccttggcgagatcgagactgacgaaaacgagctgcaggcggcgtttgagcacctggccgaacggtttcgcaggggcgaagtcgttcccgccgaaggaaaaggggcaaacgagcatggtcgcaaaggtgcacaagccacaccggtcgcgtctggcacggctgcgggcggcgatagcgaggcttga

SEQ ID NO: 7385 - DNA, 669 bp, Polaromonas JS666
atgaatctcgacaccgcgcaactgatcgccttggccggtgtcctgggctgggccagcggcgtgcgcctgtacctggtggttttcctcacgggcctggccggcttcatgggctgggtcacgctgccgccagggttgcagatgctggcccatccggtggtgctgggtgtcagcggcttcatggtgttcatggaattttttgccgacaagattcccggcgtggattcgctgtgggacgtggtgcataccgtgatccggattcctgccggtgcggcgcttgctgccggcgtctttggcgccgacagcggcatgatggcgctgatcgcggccctgctaggcggcacgctggcggccaccagtcacgcagccaaggccaccacgcgcgccgccatcaatacctcccccgagcctttcaccaacgtcggcgcgtcgctgctcgaagacggtcttgtgccgctgggtttgtggttggccattgcccacccgctggtgtttgcgttgatgctcgcgctggtgctggtggccagtgtctggctgattcgcatttgctggcgctttttaatgcagctgtttacccgcgtcgcccgcattttcagcggcaagccggatccgggcctgtcgcctgcttttaccttgaagtcacccttttcaaagaacgacccacatgtttaa

SEQ ID NO: 7386 - DNA, 609 bp, Acidovorax avenae citrulli AAC00-1
atgccgggcctgctggcgctcgccgcggggctcggctgggccagcggcttccggctctacgcggtggttttcctcgtcggcgcgatgggcgcgggcggctggctggcgctgccggaggggctgcgcatgctgcagcacccggccgtgctgctggtgagcgggctgctgctgtgcgtggagttcgtcgccgacaaggtgccctggttcgacaacctgtgggacgccgcgcatgccgtgatccgcgtgcccgcgggcgccctgctggccgctggcgtgttcggcccggacaacggcggcatggcgctggcggccggcctgctgggcggctcgctgtccgccacggcgctggccaccaagatgaccgcgcgggctgccgtcaacacgtcgccggagcccgtgtcgaactggctgctgtcgtttttcgaggacggcctggtcgtggtggtggtctggctggccacgcagcatccgttcgccttcggcatcgcgctggcctgcatggtggcgctgtcggtgctggtgctggtggtgctgctgaagttcctgcgcgccgtgctgcggcggctctcggctttcttttcccggcctgcggccccggccacgagatga

SEQ ID NO: 7387 - DNA, 720 bp, Acidovorax sp. JS42
atggacgcgttctggctccagatcgtgcagtggctccacagcgtggggttgcatgtcgatgcgggtaccgcccaggcggtggccgaaggggctgcgcgcgccacgcagcagctggacatgcccgcgctgctggcgctggccgccgcattgggctgggccagcggctttcgcctgtacgccgtggtgttcctggtgggcatgatgggcttggccggctggctgccgctgccgccggggctggcgctgctgcagcacccgctggtgctgatggccagcggcttcatgctgctggtggagttcttcgccgacaaggtgccctggttcgacagcgcctgggatgccatccacgccttcatccgcgtgcccgccggcgcgctgctggccgccggcgtgttcggtgccgacaacgccaccatggcgctggccgcggggctgctgggcggctccctctcggccacggcgctggccaccaagatgaccacgcgggcggcggccaacacctcgcccgagccgttttccaactggggcctgtcgttctttgaggacggcctggtcgtcggcgtggtctggctggccacgcagtacccgctggccttcggcattgcgctggcggtgatgctggcgctgtcggcgctgcttctggtggtgctgttcaagttcctgcgcgccgtgctgcggcgcatttcctctttcttttccgattccgccaaggtggcctga

SEQ ID NO: 7388 - DNA, 672 bp, Polaromonas naphthalenivorans CJ2
atgcaagccctggacaccgctcaactgatcgctttggctggcgccctgggctgggccagcggcgtgcgcctgtatctggtgatgctgctgaccgggctggccggctacatgggctggatggagctgccgcagggcctgcacctgctggccaatccggtggtgctgggcgccagcggcttcatggtgtttgtcgagttcttcgccgacaagattccgggcctcgattcgctctgggacgtggtgcataccgtgatccgcatcccggccggcgctgccctggcggcgggcgtttttggcgccgacagcagcgcgatggggctggcagccgccctggtcggcggcacgctggccgcgaccagccatgcggccaaggccaccagccgcgccgccatcaacacctctcccgagccgttcaccaacatcggcacctcgctggtcgaggacagcctggttccggcggggctgtggctggcgattgcgcatccccttgtcttcattcccttgctggcgctggtgctggtgctcagcatctggctgatccgtctttgctggcgctttttgacccagctgtttgcccgcgtggcgcgtattttcagcggcaagcccgatgccggattgccgcccgcttttaccctgaagtcccctttttcaaagaacgacccccatgtttaa

SEQ ID NO: 7389 - DNA, 645 bp, Methylibium petroleiphilum PM1
atggaactgccggcggtgaacgcgctcgacaccacccatctgatcgcgctggccgccgcgctgggctgggccagcggcctgcggctctacgcggtgctcgccatcaccgggctggtgggctatgccggctgggtgcagctgccgcccggcctgcaactgctgcagcacccggcgatgctggcgggcagcggcttcatgctgttcgtcgagttcttcgccgacaagatccccggtctcgattcgctgtgggacctggttcacaccgcggtccgcatcccggccggcgcggcgctggccgcctcggtgttcggcgccgaccacgccaccgccgcggcgctggcggccctgctgggtggcacgctggccgcgaccagccacgttgccaaggcgaccacgcgcgccgcggtcaacacctcgcccgagccgttctccaacatcggcatgtcgctgctcggtgatctggcggtgccgtcgatgttgtggctggcgttcgagcacccggtgctggcgatcgccggcgtggccgcggccttcgtcggcatgctgatcctcgtgtggctgctctcgaagttcctggcgcgcttgtgggcccggttgaagatgctgctgggtgcggcgtcggccacggcaacggagtcccgttga

SEQ ID NO: 7390 - DNA, 750 bp, Delftia acidovorans SPH-1
atgagcaccctgaccgactccctcgtccagtggctgcagtccgtgggcctgtacccgggcccggccgtgcaccacacggtcagcgaggcggctggcgaagtggccgagcgcgtgggccaggccaccagcggcatggacatggccggcctgctggcgctggccgccgcactgggctgggccagcggctttaggctctacgccgtggtcttcgtgaccgggctgctgggcgcgctgggctgggtggcgctgccgggcgggctgcatgtgctggagcatccggccctgctgttcgccagcggcgcgctgctgttcgtggagttcttcgccgacaagatccccggcgtggactcggtctgggacctgctgcaaagcgtgatccgcatcccggcgggcgcggcgctggcggccggtgtcttcggcgccgacagcgcgaccatggccaccatggcggccctgatgggcggctcgctggccctgtccagccaggtggccaagagcacggcgcgcgcggccatcaacacttcgccggagccgttttccaacgtgggcgccagcctggtggaggacggtgcctcggtgggcgcgatctggctggcgctcacgcatccgctggccttcgccgccgtgctgctggtcgtggtcatcgccctgtggctgctgacctgggcgctgtggcgctttctcaaggccgtggtgcagcgcctgcgcgcgctgttgggcgggtctcccgcgatgaatcaaaaaccatag

SEQ ID NO: 7391 - DNA, 720 bp, Diaphorobacter TPSY uid29975
atggacgcgctctggctccagatcgtgcagtggctccacagcgtggggctgcatgtcgatgcgggtaccgcccaggcggtggccgaaggggctgcgcgcgccacgcagcagctggacatgcccgcgctgctggcgctggccgccgcattgggctgggccagcggctttcggctgtacgccgtggtgttcctggtgggcatgatgggcttggccggctggctgcctctgccgccggggctggcgctgctgcagcacccgctggtgctgatggccagcggcttcatgctgctggtggagttcttcgccgacaaggtgccctggttcgacagcgcctgggatgccatccacgccttcatccgcgtgcccgccggcgcgctgctggccgccggcgtgttcggtgccgacaacgccaccatggcgctggccgcggggctgctgggcggttcgctctcggccacggcgctggccaccaagatgaccacgcgggcggcggccaacacctcgcccgagccgttttccaactggggcctgtcgttctttgaggacggcctggtcgtcggcgtggtctggctggccacgcagtacccgctggccttcggcattgcgctggcggtgatgctggcgctgtcggcgctgcttctggtggtgctgttcaagttcctgcgcgccgtgctgcggcgcatttcctctttcttttccgattccgccaaggtggcctga

SEQ ID NO: 7392 - DNA, 672 bp, Variovorax paradoxus S110
atgaatgcgctcgacatgccccagctgctcgcactggccgcggccatcggctgggccagcggcgtgcggctgtacctggtcgtgctgctgaccgggctggccggctacttcggctgggtgccgctgcccagcgggctgcagctgctggcgcatccggtggtcatcgcggccagcggcttcatggtcttcatcgagttcttcgccgacaagatcccgggcctcgattcgctgtgggacgtggtgcacacggccatccgcattcccgccggcgcggcgctcgcggccagcgtgttcggcgccgaccatggcgcgatggccatcgtggccgcgctcgtgggcggcggcttcgcggccaccgcgcatgcggccaaggccacgacacgcgcggccatcaacacatcgcccgagccattctcgaacgtgggcgcctcgctggtcgaggacacgatggtgccaaccgggctgtggctcgcggtggcgcatccgctggtcttcctggtgctgttcgtgctggtgctggtgctcagcgtctggctcatccgcaagagctggcgctttctcaaggcgctgttcactcgcgtggcccgcatcttcagcgggcggcccgatccgggcgtcacgcctgcattccaactgaaaaagaatcctccgggagacactccgaatgtttaa

SEQ ID NO: 7393 - DNA, 264 bp, Nitrobacter winogradskyi Nb-255
atgaccggcgctgaaaccctggatgtcgcgcgcgacgcgatctggaccatcgttctggtttccggaccattgctgggcgttggcctgatcgtcggcgtcgcgatttcgctggtgcaggcattgacgcagattcaggagcagacgctggtgttcgtaccgaagatactggcgatcttcgtgacgctggttctggcgctgccgttcatggccgacgcgctgcacgccgaaatgctgcggatttcatcgcgaatcatcggcggctga

SEQ ID NO: 7394 - DNA, 264 bp, Rhodopseudomonas palustris HaA2
atgaccggtgctgaaactctcgatatcgcccgcgaagcggtctggacgatcgtgatcgtctcggcaccgctgatggtggtcggcctggtcgtcggcgtggcggtgtcgctggtccaggcgctgacccagatccaggaacagacgctggtgttcgtcccgaagattctggcgatgttcctcaccttggtgctgacgctgccgttcatggccgaccggctgcacgccgaaatgctgcggatctcatcgcgaatcgtcggcggttga

SEQ ID NO: 7395 - DNA, 267 bp, Jannaschia CCS1
atggatgagatgatcttcttcgacaccatgcgccaagggctttggatctcggtcgtcgtcgcgacgccgatcctcgcagcggctcttgtgtcgggcattgtggtgggcctctttcaggctctcacaagcgttcaggaaatgacgttgacgttcgtgccaaagctcgcggccatcgtcgtcgtgttctgggtgtcgatggggttcatgtcacaaacgctcgtttcgtacttcaccgacactcttgtgccaatcattgcggggatgtga

SEQ ID NO: 7396 - DNA, 264 bp, Rhodopseudomonas palustris BisB5
atgactggtcccgaaactctcgacgtggcgcgcgatgcggtttggacgatcgtgatcgtctctacgccgctgatggtggtcggcctcgtcgtcggcgtggcggtgtcgctggtgcaggcgctgacccagatccaggaacaaaccctggtgttcgtgccgaagattctggcgatgttccttaccttcgtgctgacgctgccgttcatggccgacgtgctccacgccgagatgttgcggatttcatcgcgaatcatcggcggttga

SEQ ID NO: 7397 - DNA, 264 bp, Nitrobacter hamburgensis X14
atgaccggcgctgaaacactggatgtcgcgcgtgacgcgatctggactatcgttctggtctcaggaccgctgctgggcgtcggcctgatcgtcggcgtcgtcatttcgctggtgcaggccttgacgcagatccaggagcagacgctggtgtttgtgccgaagattcttgcgatcttcgtgacgctggtgctggcgctgccgttcatggccgatgcgctgcacgccgaaatgatgcggatttcatcgcgaatcatcggcggctga

SEQ ID NO: 7398 - DNA, 279 bp, Ruegeria sp. TM1040
atgctaaccgaaggcattttctacgatactctgcgccagggaattttggcggcgatcactatgtcgctgcccattctcatcgcagctctggtgatcggtcttacggtcggcctgtttcaggcgctgacatccatccaggaaatgtcgctgacatttgttcctaagcttgcggggattcttgtcgttttctggctgacgatggccacgatgactcagacgctcgtcgccttctttaccggtcacgtaattcccctgattcagggaactggaggactgtaa

SEQ ID NO: 7399 - DNA, 255 bp, Rhodospirillum rubrum ATCC 11170
atgatcatggatgtggcgcgcgacgccatcttgaccatgctcatcatctcggcgccgcccttgcttgccgggatggtcatcggcctgatcatcgcgctgtttcagacgctgacgcagatccaggaaatgaccctggtcttcgttcccaagatcgtcgtcgtcttcgcctcgttgctgctgaccctgccatggatggtgcgtcaggcctcggagttcatggagcggctgatggatatcgtcaccacccttgattag

SEQ ID NO: 7400 - DNA, 267 bp, Rhodobacter sphaeroides 2 4 1
atgtccgagctcgcgctctacgatgccctccggcaggggctctgggtcgccgtgctgatctcctcgccgctcctcggggtggcgctggtggcgggcgtcaccataggtctcctgcaggcgctcacctccgtgcaggagatgacgctcaccttcgttcccaaggtgggcgccatgctgctggtcttctgggtctcgatgagcttcatgacgacgaccctcgtggccttcttcaccgactccatcgttccccggatagaggggcgctga

SEQ ID NO: 7401 - DNA, 267 bp, Paracoccus denitrificans PD1222
atggacgagaacctgatcttcgacctgacccggcaggcgctgtggatcgcggtgcgcatgtcggcaccactgctgatcgtggcgctggtgaccggcgtggtcatcggcctgttccaggcgctgacctcggtgcaggagatgacactgaccttcgtgcccaagatcggcctgatgctggtggtgttctgggtcagcatgagcttcatgaccgcgacgctggcgagctttttcaccgaccagatcctgccgcagatcgcggggtcatag

SEQ ID NO: 7402 - DNA, 267 bp, Rhodobacter sphaeroides ATCC 17029
atgtccgagctcgcgctctacgatgccctccggcaggggctctgggtcgccgtgctgatctcctcgccgctcctcggggtggcgctggtggcgggcgtcaccatcggccttctgcaggcgctcacctccgtgcaggagatgacgctcaccttcgttcccaaggtgggcgccatgctgctggtcttctgggtctcgatgagcttcatgacgacgaccctcgtggccttcttcaccgactccatcgttccccggatagaagggcgctga

SEQ ID NO: 7403 - DNA, 267 bp, Rhodobacter sphaeroides ATCC 17025
atgtccgaggccgcgctttacgacgcgctccgtcagggtctttgggtcgcggttctcatctcggcgccgctgctcaccgtggcgctcgtggtcggggtggggatcggcatcctgcaggccctgacctcggtgcaggagatgacgctgaccttcgtgccgaaggtgggcgccatgctcctcgtcttctgggtctcgatgagcttcatgaccacgaccctcgtcgccttcttcgtcgaggggatcattccgcggatcgagggaggctga

SEQ ID NO: 7404 - DNA, 267 bp, Acidiphilium cryptum JF-5
atgactgatccagcggtcatcacgtcgctccacgaggcatttcttgttgcggcgcaactatcggcgccgcctttgctcgccgcgctcgtggcgggcgtcgtgatatcgctgctgcaggcggtgacgcaaatcaacgaggcgaccattgtctttttgccaaagatggctgccgtcgccggaacattgatgatcatgggcagttttttgctcggtacgttatcgcagttcgcgcacgagatattcaccgccatgattcacgtcggctga

SEQ ID NO: 7405 - DNA, 264 bp, Bradyrhizobium BTAi1
atgaccggggctgaaacgctcgacgtggcgcgcgatgcgatctggaccatcgtgctggtgtcgtcgccgctgatggtggtcggactcgtggtgggcgtggtcgtgtcgctgttccaggcgctgacgcagatccaggagcagacgctggtgttcgtgccgaagatcatcgcgatcttcgtgacgctgctgctggccctgccgttcatggccgatgcgctgcattcgcacatgatgcggatctcgtcgcgaatcatcggcggatga

SEQ ID NO: 7406 - DNA, 264 bp, Parvibaculum lavamentivorans DS-1
atgagcggacctgaagttctcgatctcgcgcgacaggcgatttacgtgcagttgatcgtgtcggcgccgatgatggcggtagcgttgctggtgggtcttgccattgcgctcttgcaggcgctgacgcaggtgcaggaaatgacgctcgttttcgtgcccaagatcgtcgcgatctttcttaccatgctgatatccctgccattcatggcgcaggctctttccggcttcatgaccctggtcgcccagaagatcgttacgggctga

SEQ ID NO: 7407 - DNA, 267 bp, Dinoroseobacter shibae DFL 12
atgacggagatcatcttcttcgacaccctgcggcaggggctttgggtatcggtcctgatgtcggcgccgatcctgaccgtggcgctggtggcgggggtgatcgtgggtctgttccaggccctgacctcggtgcaggagatgacattgaccttcgtgcccaaggcggcgctgatgctggcggtgttctgggtgagcatgagcttcatgaccgaaaccctcacggacttcttccaggcggaaatcctgccgacgatcgagaggttctga

SEQ ID NO: 7408 - DNA, 264 bp, Rhodopseudomonas palustris TIE 1
atgaccggccccgaaactctcgacgtcgcccgcgacgcgatctggaccatcgtcgtggtatcggcgccgctgatggtggtcggcctggtggtcggcgtcgcggtgtcgctggtccaggcgctaacccagatccaggaacagacgctggtgttcgtgccgaaaatcctggcgatgttcgtcacgctggtgctggcgctgcccttcatggccgacgcgctgcactcgcagatgatgcggatctcatcgcgaatcatcggcggttga

SEQ ID NO: 7409 - DNA, 276 bp, Gluconacetobacter diazotrophicus PAl 5 JGI
atgcatcatacggtcgacattcacgatatcctgcgccagacgctgattgtcgccgtgaagatgggggctccatccctgctggcgtccctgtgcgccggcgtgctcgtttcgttgttccaggccatgacgcaggtgaacgaagcgacgctgtcctttgtgccgaagttcgtcgcggccatggccgctcttctgctgaccgggtcgttcatgtattccacgctgaatacatacgctcacgtcattttcgaccagatggtcatggtcggcggttcgtga

SEQ ID NO: 7410 - DNA, 267 bp, Methylobacterium nodulans ORS 2060
atgaccggccttgccattctcgacatcgcccgcgacgggatcgtcaccttcctgaaggtgggcggcccgctgatggtggtcgcgctcatcgtcgggctcgcggtgtccctgctccaggccctcacgcagatccaggaacagaccctgatctacgtgcccaagatcgtcgcggtcttcgccgccatgctgctgatgctccccttcatgggggacgcgatggcgggctacatgacccggatcgccgcccgcatcgccgcgggcggctga

SEQ ID NO: 7411 - DNA, 330 bp, Moorella thermoacetica ATCC 39073
atgtggatcccattaataggtcttatcgtgggtgtagtggccgggctcctgctgccggtaaagataccggttgtctatagcaagtatatgtcggtagccgtactggcagccctggattcggtattcgggggcctgcgggcgagtatggaagataatttcgataatgccatattcctgaccggttttttctctaatactttactggcggccttcctggcttatatcggtgaccagctgggagtagagctttacctggcagcagttctggtcttcggcgtgcgtttgttccagaacctggcgattatccggcggcacctgttaaaaagataa

SEQ ID NO: 7412 - DNA, 288 bp, Syntrophomonas wolfei Goettingen
atgcaggtaccggtttttctgagtgtggtctatgccaagtatatgtccattgcggttattgccgccctggatgcggttttcggtgggattcgagcttatatggaagataatttcgataccaccatctttgttagtggttttgtggtcaatactctcttggcagctggcatggcttatttgggggacaggctgggggttcagctttacctggcagcagtagtggttttcggtgtacgcatattccaaaatttaggaataatccgtcgatatttattgaaaaaatattaa

SEQ ID NO: 7413 - DNA, 378 bp, Clostridium thermocellum ATCC 27405
atgattcctttatttggtttgattattggaattttgattggaatatttattccatacagtattcctgagcagtattcaagctatgtggcagtagctattcttgcggcactggattctgtttttggaggtattgtttccaccatccagaagaagtttgatatgggaatttttctgtcaggctttttcggaaatgctcttttggctgccgcacttacttatataggggacaagcttggaatacaaatttatttcgctgcgatatttgcttttggaaacagactgtttttaaattttgctgttattcgaagatttctattgaataagttaaccaaaaaggataatattaaagataatatgatggaaactaaagaagcttaa

SEQ ID NO: 7414 - DNA, 342 bp, Desulfotomaculum reducens MI-1
atgtggacaggtatcatattggccgcggctggattaactgtgggtattttagttggtttgaatgtaccattggtattaccccagatttatgcccaatatctgggcttagctgtgttggcggctttggactcggtttttggaggtgtccgtgctgctttagaaaatcactatgataaccatatctttattacaggttttttcagcaatattcttttagccgccggactggcctatattggaaccaaattaggcgttcccttaagtacagccgctgtagtggcctttggtgtgcgtttatttcaaaatcttgccatcatacgacggtatttattgaaaaaataa

SEQ ID NO: 7415 - DNA, 327 bp, Herpetosiphon aurantiacus ATCC 23779
atgtggattccgctggcggggctgggagtcggggtggcgattggacttgtttccggtctgacaatcccctcgcaatttgcccgttatacagcggtggcagttttatcagcgcttgattcgattgttggggcaacgcgagcaacaatcgaaaaacgctatcggaatcggatttttatttcgggattaattggcaacactgtattggcggttgtgctggcgtttcttggtgagcggctaggcattgacctctatttggcggcagtggtggcctttggtgtccgtttgtttgaaaatgccagtcgcattcgacaacacctggttggctag

SEQ ID NO: 7416 - DNA, 345 bp, Thermoanaerobacter sp. X514
atggcttatattataataattagtttattaataggaatagtgataggttttattttgccaattaatatccccagcacttatgtttcttatttatctgttgctattcttgcagcgttggattcagtttttggtggtattagagctagtcttgaagagaagtttgacaatcttatttttataactggtttttttggcaatgcgatattggcaggaggccttgcttatattggggatgtattaggagttcccatttatcttgcggcaatttttgtatttggaagcaggctatttgtcaattttgcatatataaggagatatctgatagacaagatgcggagaagatag

SEQ ID NO: 7417 - DNA, 363 bp, Clostridium cellulolyticum H10
atgataccgattttaggattgattctcggaataattgtaggtttgtttattccaataactataccatcagaatatttcacatatgtggctgttgccatacttgctgcattagactctgtctttggtgggatagtggctggtataaacaaaaaattcgagatgagaatattcctgtcaggattttttggaaatgcattgcttgcagcaggccttgcttatattggagacaagctgggaatacagatatattttgcagctatttttgcctttggtaacagacttttcttaaactttgctttaattagaagatatctattgaataaaatgtttaaaaaagataatatagttaaagaagatgcttaa

SEQ ID NO: 7418 - DNA, 363 bp, Geobacillus WCH70
atgtggctcccgctcatcggcttattcgttggtttaatagtaggatttttgagcgatttgcgcgtccctgacgaatattccaattatttatccattgcaatccttgctgcatttgatacattaattggtggactccgcgcccatttacagcaaacatatgacgaaatagtatttataacaggattcttttttaacattattttggctacaactttaacttttcttggtgtccatcttggtgtagacttgtacttagcagctgtatttgcatttggggtgcgcctttttcaaaatatcgctgtcattcgccgcctccttcttgccgaatggatggaaaggcgacagaaccgtgaaaaaagttaa

SEQ ID NO: 7419 - DNA, 378 bp, Desulfotomaculum acetoxidans DSM 771
atgtggctgggtgtttggttggccgttctcggtttgtttttgggggttatgattggccttaatgttccgttaattttaccgtcaatatatgctcattatatgtcggtcgctgttctggctgctttggattcagttttaggcggtattagatcggctatggaagataaatttgataatggaatttttctcaccggttttttcagcaatgcactcttggcagccggtttggcttttatcggggaaaggctgggtatcgaactttatctggctgcggtagtggcttttggagtaagattatttcagaatctggctattattcggcgtcacttacttaaacgatcttatgttataaaagaggaaaacaggctttcgcgttga

SEQ ID NO: 7420 - DNA, 378 bp, Alicyclobacillus acidocaldarius DSM 446
atgtactggctgcccgttttaggcttggccgttggcatcgggctcggcttggtgaccaacgtcgtcatccctgtcgcgtttacgagctacctgtcgatcgccatccttgccgcgctggacaccgtcgtgggcggcattcgggccagtctcgacaagacgttcgacagcgccgtgtttctctccggctttttcaccaacacgttggtcgccgccctgttggcctacatcgggaaccagctcggcgtggatttgtatttggcggcggttgtggcctttggcgtccgcctgtttcaaaacatcgccgtgatccgtcggcacgtgttcacgctcatccggcagcggcgagtggctcggcgcatggcgtccaccaaggattga

SEQ ID NO: 7421 - DNA, 579 bp, Thermoanaerobacter sp. X514
atgttttattatattgctaaagttattgtacggacaatcataaaagtgatatttagaatagaaatacgaggacttgaaaatatccctaaaaaaggtccggtaatcatatgttctaaccatataagtcttttagatcctcctgtcataggagcccttttaaataggcgaatatactttatggcaaaagaagagctttttaaaaatccttttttaaggcttcttttagggacaggcttaggggcttttcccgttaaaagaggtactgctgatttatcagctattaaaactgctttaacttacttaaaaaaaggaagagcaattggaatttttcctgaaggtacaagaagtaaaactggtcagcttcaaaaggctgagccaggagttgctatgttggcaattaaggggaatgccccagtagtgcctataggaattaaagggagatatcgtcttttttctaagattattataaatatcggtaaaccaataagttttgtaaaatatgcaaattctaaactttcctctaagcaactttctgttattggggaagaaataatgcaggaaattgcaaaattgctgtag

SEQ ID NO: 7422 - DNA, 630 bp, Sulfurihydrogenibium YO3AOP1
ttggagaaaaaagccccatactcagaatttggttataaagttttttataaagtcagaccggcgttaaaaaagctattaaaaataaatgtcgtagggcttgaaaatataccattgaccggtggctgtatcttagctgccaatcacagaagccatttagacccaccagttttaaacatcatatctccaagaccaataatcttcttagcaaaaaaagagctttttgaagtgccaatccttggttggataattagaaaggctggggctattcctgtaaaaagagacaatagagatttaagcacaataaaaaaagccatctctttacttaaggaaggttatgtaataggaatttttccggaaggaacaagagcaagaccgggagagtttagaaaaccacaaccaggagttggctatcttatagaaaaagcaaaagttccagtgataccaattcttattgaaggtacagataaaatactaccagtaaaatcaaaatttcctaaattattcaagtataatattgatgtaattattggaaaacctataaattttgaaggaatatcatcttacgagcatgtggcagaaaaagtaatgcatgaaatcaaaaagttaaaagaggtaaaaagagatggctaa

SEQ ID NO: 7423 - DNA, 636 bp, Dictyoglomus turgidum DSM 6724
atgaggcaaattagaaagtctatctctcattttttctacaaaatcttaatagttgtggtaagatttttattgaatatcctatggggatacaaggtagaaggaaaggagaatattcctaatcattcttttatccttgtagcaaatcatgtaagtatattagaccccatagtgattggtgctgcttttgacaagaggttattttatcttgctaaaaaagaactctttaaatcaaaaatatttaatccttttttaagatggcttggagcaattgatgtagatagaaaggattttaaatacgaaacttggaaaaaaataaacagactaattaaagagaatgaaataatagtaatatttccagagggaacaagaaatgatcatcctgaaaagggacttcttgaacttaaagatggtgctgcttctctcgcattaactcatggacttcctattcttcctgtagcaataaagggcaccgagaaaatatggaaaagaaaatggatctttcctcaattaaggggacgaataaatattagaataggtaaagtaataaatgtatctaaaattaaaaagccttcaaaagaggatataaaagaggtaaataataaaataaaggcaagtttaatagggcttttaagatga

SEQ ID NO: 7424 - DNA, 576 bp, Anaerocellum thermophilum DSM 6725
atgaagtataatttttttctcaaccttattcggaaggttgcttttatcattttaaagtgtatctttttcataagagttgaagggaaagaaaatataccagaaggtccttttattatctgcgcaaatcacagaagttatcttgatccagttttgattatacttatattcgacaggcgagtatattttatggccaaaagtgaactttttaaaatatggtggcttgcaccaatcatcaaagcttttggagctttccctgtcaagcgtggcaaaagcgatattggagcaataaaaaaagctatagaggttataaggtctggcaatattctgggtattttcccagaaggaaaaagaaacaggacaaaagaaattattttaaaaggtgaaaaaggcgttgcaactgtaattaaagcaacaggtgcaaaggtcttaccagttggtatttctggaaaggtagttccatttggtaggataaaagtgagaatcggaaggccaatggaatttagagataatagtatggataatcaagagattgttgatacaattatgaatgaaattaaagaacttatcctaaaataa

SEQ ID NO: 7425 - DNA, 768 bp, Acidimicrobium ferrooxidans DSM 10331
gtgatcgaggtcggctcgttggcccagcgggccttctaccgcggcgcgcgcgagctcgtccggctggccaatcgggccatgttcgctgtcgcggtcgggttcgaggaggcgctgcccccggcgccctacatcctcgcgccgacgcatcgctcgaatctcgacacgcccttcatcggctcgatcacgggcgagccgatgacctacatggccaagtccggcgtcatggaggcaccgggtttcggcgcgcttctgcggctgctcggtggattcccggtgcaccgcgaagcgaccgatcgggaggcgatcgagctcgcgctcgcggcgctcggcagcgggcgctcgctcgtggtgttccccgaagggacgcgccgtcgcggcgagcgcgtggagggcatcgaggagggagcggcctacctcgccttgcgggcgggcgtgccggtcgtgccggcggccatcgccgggtcggagcgggcgatgcgccctggatctgcactgatcctcccggctcccgtggcgatcgaggttggtcgagccctctggcccggcgaagttcgcgcatcctgggccgggcgcgttcggcgccaggagatccgccagctcagcgagatgctcgagtccgagctcaatcggctcctcgctgcggctcgacgctcgcgagccctcatcgtcgcctccgggcggcgggtggcgtctgatccgacgcagctgccgaagctccctccggtccatgagcgttcgatccgtctcgacgggacgcaggcgatctga

SEQ ID NO: 7426 - DNA, 876 bp, Eggerthella lenta DSM 2243
atgagcctgttcctcccgtacgagaagatgtgggatatgccgctgggcggcacgtccgacgagaagcaggtgccgcactgggccggcaacctcatctggggcttcttggctttcgtgttcaagatctgcttccgctaccgggtcgaccaccgcgagagtttgcgcggtttcaaggacaagaccggggtggtggtcgtcggcaaccatacgtcgttcctcgacgtggcgtttatgtacctggccggacggccctcgcagtgggtgcgcttcctcgggcgcgagaacctgttcggcaacgcgcacggcctggtgggccaggtgctgtcgcgcgtgggcgcgtttcccatcaagcgcgacgcggccgaccgcaccgccatcaagcgcgccacgcgcatgctgaagagcaacgagatcgtggggatcatgcccgagggaacccgtcgcggcaaaagcgatcgcacgcccgagctgcactcgggagccgcgttcatcgcgaagatggggcacgcgcccatccttcccatgaccgtgcgcaacgccgagcacgtgaagcacaagggcgagcgcttccgtttcccgaagatcaccatcgagtacggcgaccccgtcctcgtcgaagacttcgacttcctgccgaaggaagaccgcttggacggctgctcgtggtacgccatgcgcgagtgcttcgcgctgtcgctgaatgtgccgcgcgagcaggtggacatgccggcgctgttccccggcggcaaggacttcacggccgtgttcgccgagcaccccgtcccgcatcatacgacggccgaggtcgtcgccggcatcgaggccaaggcggccgcgaaggccgcgaaggcggcgaaggttcaggaggtcgcatga

SEQ ID NO: 7427 - DNA, 786 bp, Cryptobacterium curtum DSM 15641
atgccacacgtatattcacccgaagagctctttgatatgccctttatgggcacctccaccaaaaaacgcgcaccgcattggctgggcaatattctttgggttatcgttgtatttctctgcaaaatttttacacggtatcgtgtgcatggtattgagcacctgcgcgcgtttcggggacgttcaggggcggtagtagcctgcacacatgcgtcgtttttggacatcgcttacatgtattgcccgccgcggcctggtcaatggcttcgcctgatggcgcgcgatactctttttgaaaatccaattacggcgtttatctttgcgcgatgcggggggtttccggttactcgtgattcagctgaccgtgcatcgataaaacgtgccgtgcgcatgttgaaagagggggagctcgtcggtatttttcctgagggtactcggcgagggaaaacgagcatcacccccgaagtgcatggtggtgcagcgcttattgcacgcatggcgaaggtgccgattattccggcggctgtttcaaatgttgaacgtgtcaagcagaaaggtcatctgccacgccccgtgcgggtggatgtacattatggcaaacccattgatgtttcttcgtttgatttcttgccaaaagaagaacgccttgacggttgtatgtggtatgtaatgcgcgaatgctttgctttgcgcgatggtattaatcccgaacaggttgatatgcgggtactctttcccgatgcaaaggactacaccgaagcgtttcgcgcggagcaacgggaaggatag

SEQ ID NO: 7428 - DNA, 807 bp, Slackia heliotrinireducens DSM 20476
atgatttcctacgagaagatctgggacatgcctgtcatgaccgcggcccagcgcggacagggcgacgacaagaccgagccgtacagttcgcaggtcatgggcaacatcatctacgcggtggtgggcctcatctgcaaggtcgccttccgctacaacgccgaggggttggaaaacttccgtcagtttgccggcaaacagggctgcgtggtggtgagcgcccacaggtcgtttttggatccggtgtttctgtggctgacggcccgtcccagccaatggatccgcttcatggcccgcgagaacatcttccccaaagccaacgggcttttgggctggatctgctccaaggtgggggcgtttcccatcaagcgcgattccgccgaccgtacggccatcaagcgcgcggcggccatgctgaagcgcggcgagaacgtgggcatctttccggagggaacccgtcgcggccgcggcacgacgaagctttcgctgcacagcggtgcggcgttcatcgcccgcatgggcaaggcgcccatggtgccgacgggcatccgcaacgtcgagaacatcaagccgcccgaggccaggttcgtccgcttcccgaaggtcacggtggtgtacggcacgcctgtgaacttggaagattttgattttcttccgaaagcggagcgtttggacgcggcctcttggtatgtcatgcgagaatgctatgcattgcatgacggcgtgccgcgcgaggatgtggacatggcgtccctcttcccagaggcgaaggactacacccaagtgttcgccgaacacgccattccgtaa

SEQ ID NO: 7429 - DNA, 477 bp, Pelobacter carbinolicus
atggaacgcccgtcctgggaagaatattttatggaaatcgcccgcctggtggcgcgacgctcgacgtgtctgcgccgccaggtgggagcggttctggtcaaggataaaaatatccttgctacgggctataacggtacgccttccggtctgcgtcattgcagcgaggtcggctgtctaagacaattgcagaacgttccttccggtgagcgtcatgaactgtgtcgtgggctgcatgccgagcaaaacgccattattcaggctgctaaacacggtaccaatatcagtggcgccattcttttctgcaccaacactccctgtgtcatctgctccaaaatgatcatcaacgccggtatccggcaggtggtctaccttgacgggtatcccgatcatctgtcccttgatatgttggctgaatccggagttacggtatccgcactgaacgatctgcttgccgataaggagctgtctccgttatga

SEQ ID NO: 7430 - DNA, 468 bp, Desulfovibrio desulfuricans G20
atgcacagcagacttccctggcctcattattttatggacatcacctatcttgtggccgagcgttccacctgcacgcggcgcaaagtgggcgccatcgcggtcaaggacaaacgcattctggccaccggttacaacggtgcgccctccaatgtggcgcactgccttgatgtgggctgcctgcgcgaagagctgggagtgccttccggccagcggcacgaaatatgccgtggcctgcacgccgaacagaacgtgattattcaggcagccatccacggggtatcactggccggtgcggaaatatactgcaccacgcagccctgccttatctgcacaaaaatgctgataaactgcggagtgacagcagtgtatttcatggaaccctatccggacccgctctcagaggccatgatgcgcgaagccggagtgaaatttgaagtgcttgattatcctcaggccggacggaaatag

SEQ ID NO: 7431 - DNA, 408 bp, Moorella thermoacetica ATCC 39073
atgcgtaaagagtgggacgaatactttctggacattgccttccaggtagccagccggagtacctgcaaccggctggctgtaggtgccgtggtggtaaaagacaagcgcatcaaaggcaccggctataatggcgccccccacggcctgccccactgcctggaggtcggctgcctcatggagggcgagcactgcctgcgtaccatccacgccgagatcaacgccctcctggagtgctcgccggaggaacggcagggggcgaccatgtatgtcaccgactacccctgcgagaggtgtgccctggtcatcgtccagtccggcatcaaaagactcgtctatgcccggccctatcatgtcaaccacgactggctcctggaagcagggatcgaaatcgtccatctgccccggtaa

SEQ ID NO: 7432 - DNA, 471 bp, Syntrophomonas wolfei Goettingen
atgtttggtgagaggcccgattgggatgaatattttttgcaattggctgatttggtagcaacacgctccacttgcctgagaaggcaggtaggggctgtgctggtaaagaatgagcgcattatttccaccggctacaacggagctccgcgtggactagagcattgcctggatataggctgtttacgtgaggaacaaggtattccctcggggcatcgctatgaattatgccggggggtacacgctgaacaaaatgctttaattaatgccgcttattatggaataagcaccgcggaagctgtaatctattgcaccaatcagccctgtattatttgtgcccgaatgataataaatgctggtataataagaattgtgcaccggggtaattttgatgatgatttggccataaaatttttaaaggaagcaggcatagagctggtactcataccccggcaagctaaccatagcagataa

SEQ ID NO: 7433 - DNA, 531 bp, Desulfovibrio vulgaris DP4
atgtcccgtatgccctggcccgactatttcatgcagataacctatctcgtggcggagcgctcgacctgcacccgtcgcaaggtcggggccattgccgtcaaggacaagcgcatcctcgccacgggctacaacggcgccccgtccaatgtggctcactgcctcgaggtgggatgtctgcgcgagcaactgggcgtcccctccggacagcgccacgagatatgccgcggcctgcatgccgaacagaacgtcatcatacaggcggccatccacggcgtttcgctgacgggttccgaaatctactgcaccacacagccctgcctcatctgcaccaagatgctgatcaactgcggagtacgtgccgtctactacaccgagtcctaccctgacagccttgccgaagccatgctgcgcgaggccggtgtgtcgtatgcggtgatggacttcaagcctgcgcctgcatcttccgcaaggatatctggcccctgcggctgcgacggcgttgcctgcggctgcggcaccggagaaggctag

SEQ ID NO: 7434 - DNA, 444 bp, Desulfotomaculum reducens MI-1
gtgcgcccttcctgggatgaatacttcatggaaattacccgggtggttgccacccgttccacctgtctgcgccgtaaggtaggtgcggtcattgttaaggacaaccgcattctggccaccggctacaatggtgctccggcgggtcttacccactgcttggaaataggttgcctgagagaaaaattgggggtcccctcgggccaacgccatgaactatgtcgggccttgcacgccgaacaaaacgctattatccaggcggcggtacacggtacggcaattcagggcagtatcatctatgtaacggatcaaccctgcgtcatgtgctccaaaatgattgtcaatgcggggattaaaaaagtgatctttgccggcgactatccagacgacctctctttgcaaatatttaaagaagcctgtatagaactggttaaagcaacgagttag

SEQ ID NO: 7435 - DNA, 468 bp, Candidatus Desulfococcus oleovorans Hxd3
atggataaaccgcatacggacaaaccggcccgacccgactggcacacctatttcatggagattacggaactggtggccaggcgctccacctgcctgcgacgtcacgtgggagccgtgatcgtcaagaacaagcgaatgctggccaccggttataacggggcaccggccggggtcacccattgcagtgaaaccggctgcctgcgcgccagactcaatgttccctccggcgagcgccacgaactgtgccggggcattcacgccgaacagaacgccattatccaggcggcctttcacggggtttccattcagggggcgtcgctgtactgcaccaaccagccctgttccatctgcgccaagatgatcatcaatgccggtatctcggcggtctattataaggatgggtatgacgatcccatgtccctggagatgcttgccgaagccggggtcgagctgatccggctgccctga

SEQ ID NO: 7436 - DNA, 549 bp, Desulfovibrio vulgaris  Miyazaki F
atgtccgcgctgtcccgcctgccttggccccagtacttcatggagatcacctacctcgtggccgagcgctccacctgcacccggcgcaaggtgggggccatcgcggtgaaggacaagcgcatcctggccacgggttacaacggcgcgccctcgggcgtggcacattgcctggacgtgggctgcctgcgcacccagcttggcgtgccttcgggccagcgccacgaaatctgccgggggctgcacgcggaacagaacgtcatcgttcaggccgccatccacggcatttcgctggccggttcggaaatctactgcaccacccagccctgcctgatctgcaccaagatgctcatcaactgcggcgtcacggccatccgctacgcggagtcgtaccccgaccaactggccgaggacatgctgcgcgaatcgggcgtgcgctacgaggtgctgcccttcaccccgcgcacgggcagcccgtgcctgccgccggatgccccggctcccgatcatggtgggggctgtggcggcggctgcgcctgcgggggcaggtag

SEQ ID NO: 7437 - DNA, 477 bp, Desulfovibrio desulfuricans ATCC 27774
atgcaaagattgccctggcccgagtacttcatgaacatcacctaccttgtcagtgggcgctccacctgcacgcgccgccgggtgggggctgtggcagtgaaggacaaacgcattctcgccaccggctataacggtgcgcccgcgggagttccccactgtcttgaggtaggctgcctgcgcgaacagatgggcattccatcgggacagaggcatgaaatctgccgggggctgcacgcagaacagaacgttatcatccaggcggccgtgcacggcataaatatcagcggagccgaactgtactgcaccacccatccctgcgtgcaatgcagcaaaatgcttatcaactgcggtataaggcgcatctattacgccgagcactatcctgacgagcttgccactaccatgctcaaggaagccgggattcaactggaaaggctggactttaccccacccgccataagcccccggccggagtag

SEQ ID NO: 7438 - DNA, 462 bp, Desulfomicrobium baculatum DSM 4028
atggacaaccgcatcccctggccgcagtatttcatgagcatcgcctacctggtggccgagcgctccacctgtctgcggcgaaaggtcggagccctggccgtcaaggacaaacgcattctggccacaggatacaacggcgcgccggcggggctgacgcattgccttgacctgggctgcatgcgcgaaaagctcggcatcccctcgggccagcgccatgaactctgccgcgccctgcatgccgagcagaacgtcatcatccaggccgccatccacggggtgggcatcgagggcgcggatatcttctgcacgacccaaccgtgcatcctctgcgcaaaaatgctcatcaactgccgggtgcgggccattttcttcgccgagggctaccccgacgaaatgtcccgggaaatgctcgacgaagcaaaaatcccctatacgcgactggagaagccagccgatgcatga

SEQ ID NO: 7439 - DNA, 465 bp, Desulfotomaculum acetoxidans DSM 771
atgaaaagaatttcctggcacgagtactttatgggccaggctaaaataatagctctgcgttcctcctgctccaggctttctgtaggatgcctgatcgtaagagacaggagatcaattgccggcgggtacaacggttcggtttccggagatgtgcattgcctggacgacggctgccgcatagataacgggcactgcgtccgctgcgtgcacgccgaggctaacgccatagtacagtgtgcaaaattcggcgcttcgacggaaggcactgatatatatgtaacccatttcccttgtttaaattgtgccaaactgatcattcaggcaggtataaggcatgtctactacgaacaggattaccggatcgatccgtattgtatggagctttttaatctggttggagttaaggtgactaaaatcacctgtaacttgtctgattacctgaagttaactgacagtaatttgtaa

SEQ ID NO: 7440 - DNA, 462 bp, Desulfohalobium retbaense DSM 5692
atgaccccccgtctgccctggcccgactatttcatgcgcatagcgcatcttgtggccgagcgctcgacatgcctgcggcgccgggttggggcgattgcggtcaaggacaaccgtatcctggccaccgggtacaacggcgctcctgccggcttggcccattgtctggatatcgggtgtctgcgggaaaaaatggggatcccctccggggaacgccacgaattgtgccgtggactgcacgctgaacaaaacgtcattattcaggccgcagtccacggcattcctctcaagggcgccgagattttctgcaccacgcagccgtgtctgatctgtaccaaaatgcttatcaattccaacattacggctatctatttcgctgaaggctatcccgatgccttggcgcgggagatgctggaagaagccggtgtcgtctatgagcgatttacgcctgccgcagaacgctaa

SEQ ID NO: 7441 - DNA, 273 bp, Ralstonia solanacearum
atgagcgggccggacagcttcgcggccggcttcgaggtgccgctacatcgctcgctcaccgagccgatcctcatgggcggcgcaccgcgcaccgtggcaattgccaacggtacgctggccgccgccgtcgggctgggcctgcaactctggattcccggtgtcgtgctctggatcgtcggtcactcgatggccgtgtggggcgcgcgtgttgatccgcagttcatgcaggtcttcgcccggcacatcaagcacaagtcgctgctggacgtatag

SEQ ID NO: 7442 - DNA, 276 bp, Novosphingobium aromaticivorans DSM 12444
atggagggcgcgccgtccggactgccgctgggttacgccgtgcccgtccaccgggcgctgaccgagcacatcctgctgggcggcgcgccgcgcggcctggcgatcgccaatgcgacgctggccggagccatcgggcttggcctgcgactgtggatcgcagggctcgtgctcttcacgcttggccacatggtcgcggtctgggcggcccggcgcgatccgcaattcgtcgatgtcgcgcggcggcatctgcgcttccccaactacctgagggtgtga

SEQ ID NO: 7443 - DNA, 264 bp, Rhodopseudomonas palustris BisB18
atggaggagacgatccccggatttgctgcgcctgttcatcgcgcgctcaccgaacacatcctgctcggcggcgcgccgcgcgcggtcgcgatcctcaacggcactctggcggcagcgctcggactcggcctgcggttgtggttggccggtctgttgctcgcatttctcggtcacgccgccgcggtctgggccgccaagcgcgatccgcagttcgtcgatgtggtgcgccgccatctgcgcatccccggtcatctttccgtttga

SEQ ID NO: 7444 - DNA, 282 bp, Rhodopseudomonas palustris BisB18
atggacgcttccgccactgcagaacagccgatcccgggctttaccgtgccggtgcatcgcgcgctcaccgaaccgatcctgctcggcggcgcgccgcgcgcggttgccatcctcaacggcacgctggccgccgcactcggcctcggcctgcgtctgtggctcgctggtctcgtcctatgggtcatcggccatggcgccgcggtgtgggcaaccaagcgggatcctcaattcgtcgatgtggtgcgcaggcatctgcggatctccggacatctgagcgtctga

SEQ ID NO: 7445 - DNA, 273 bp, Cupriavidus metallidurans CH34 uid250
atgagcggcccggataccttcgcggctgggttcgaggtgccgctgcatcgctcgctgaccgagccgatcctgctgggcggtgcgccgcgcaccgtggcaatcgccaacggcacgctggccgccgccgtcgggctaggcctgcaactgtggattcctggcgtcgtgctctggatcgtcggccattcgctggcggtatggggcgcgcgcgtcgatccgcagttcatggccgtgttcgcccggcacatcaagcaccgcccgctgctggacgtgtga

SEQ ID NO: 7446 - DNA, 273 bp, Cupriavidus metallidurans CH34 uid250
atgagtgccccggacaccttcgcggacggtttcgaggtgccgctgcatcgctcgctgaccgagccgattctgctgggcggtgcgccgcgcaccgtggcgatcgccaacggcacgctgaccgccgctgtcggcctgggcctgcaactgtggattcccggcgtggtgctctggatcgtcggccattcgctggcggtgtggggtgcgcgcgtcgatccgcagttcatgcaggtcttcgcccggcacatcaagcaccgcccgctgctggacgtgtga

SEQ ID NO: 7447 - DNA, 270 bp, Sphingopyxis alaskensis RB2256
atgaacagcgcggacgacatcccgggctattacgcgccggtccaccgcgcgctctgcgagcccatcctgctcggcggcgcgccacggagcctcgccatcgtcaacggcacgctcgccggggccatcggtctcggcttgcgcctgtggatcgccggcctcgcgctctgggcgatcggccatgcactgtcggtctgggccgcgcggcgcgatccgcagtttgtcgatgtcgcccgccgccacctcaaatatccggtctggatgcggccatga

SEQ ID NO: 7448 - DNA, 270 bp, Rhodospirillum rubrum ATCC 11170
atggcgggcaccgaccccatcgacggcttcagcgttccggtccaccgggcgctgaccgagccgatcttgttgggcggggcgccacgcaccctggccatcgccaacgccaccctggccgccgccatcgcgctgggtctgcggctatggattcccggattggttctttggctgctcggccatggcgccgccgtctgggccgccaagcacgacgcccagttcgtcgaggtgatccgcaggcatctccgttaccccgcctatttgcgagcgtaa

SEQ ID NO: 7449 - DNA, 282 bp, Mesorhizobium BNC1
atggcgggcctcctgcatcatcccgatgaagtcgcgggcttctcggttccggtccaccgcgcgctgaccgagcagatcctgctgggcggcgcaccgcgcagcatcgccatcatgaacggcacactcgccggcgctgtcggtctcggattgcggctatggctggttggtctcctcatctgggcgatcggccatttcgccgccgtttgggcagcaaagcgcgatccgctctttgtcgaagtgggccgccggcatctgcgcattccgggccatctctcggtgtga

SEQ ID NO: 7450 - DNA, 282 bp, Mesorhizobium BNC1
atggcgggcgtcctcgagcaggctgcggaagtgccgggcttcaccgttccggtccatcgtgcgctgaccgagcacatcctgcttggcggcgccccgcgctcgatagctatcatgaacggcacgctggccggtgcggtcggcctcggcctgcggctctggctggtcggtctggccatctgggcgattggtcatttcgctgccgtctgggcggcgaggcgtgacccgctcttcgtggaagtcggtcgtcgccatctgcgcatccccggtcatctcacggtctaa

SEQ ID NO: 7451 - DNA, 282 bp, Mesorhizobium BNC1
atgaacgggctcggagatcataccgggccgatcgccggcttcttcgctccggttcaccgctcgctgaccgagccgattctgctgggcggcgcgccgcgcgccgtcgccatcgccaacggcaccatcgccgcagcgatcgcgcttgggctgcgcctgtggctcgccggtctggtgatctgggcgatcgggcatttcgccgccgtatgggcggcgcggcgtgacgcccagttcatggacgtgacccgccggcacctccgctatccgtccttcatgcgcgcgtga

SEQ ID NO: 7452 - DNA, 285 bp, Burkholderia ambifaria AMMD
atgaccgccgccaacgaaggagcgccggccttcgcgtccggtttcgagatcccgctgcatcgctcactgaccgagccgatcctgctgggcggtgcgccgcgcaccgtggcgattgccaacggcacgctggccgccgccgtcgggctgggcctgcaattgtggattcccggtgtggtgctgtggatcgtcggccattcgctggcggtgtggggcgcgcgcgtcgatccgcagttcatgcaggtcttcgcccggcacatcaagcacaagccgctgctggacgtgtag

SEQ ID NO: 7453 - DNA, 270 bp, Shewanella sp. ANA-3
atgagcacggccaacgatcttcccggcttcgaggtgccgctgcatcgctcgctgaccgagccaatcctgcttggtggtgcgccgcgcacggtcgccattgcgaacggcacgctggccgccgccgtggggctgggcctgcaactgtggattcccggcgtggtgctctggatcgtcggccattcgctggccgtatggggcgcgcgtgtcgatccgcagttcatgcaggtcttcgcccggcacatcaagcacaagccgctgctggacgtgtga

SEQ ID NO: 7454 - DNA, 294 bp, Paracoccus denitrificans PD1222
atgagcggtagcgaatggcaaagcttcgagaccctcgacgcggtgccggggttcagcgttccggttcaccgcgcgctgaccgagccgatcctcctcggcggcgccccacgctcggtcgccattctgaatggcacgctcgccggtgcggtcggcctcgggcttcagctctggctggtcgggatcctgatctgggccgtcggccacattgctgctgtctgggcggccaggcgcgatccgctcttcgtcgaggttgcgcgccgccatttgcgcattcccggtcatctctcggtgtga

SEQ ID NO: 7455 - DNA, 282 bp, Paracoccus denitrificans PD1222
atgtccgcaggtttcgagcagctttccgaggttccgggcttttcggtcccggtgcatcgcgccctgaacgagccgatcctgctcggcggcgcgccgaggagcatcgccatcctgaacggcacgctggccggcgcggtcggcctcgggttgcagctttggctggccggtatcctgatctgggccgttggccatctcgccaccgtctgggctgcgaaacgcgatccgctcttcgtcgaggtcgggcggcggcatctgcgtctccccggccacctcgcggtctga

SEQ ID NO: 7456 - DNA, 270 bp, Acidovorax avenae citrulli AAC00-1
atgagcaaggccactgatcttccgggctttgaagtgccgctgcatcgctcgctgaccgagccgatcctgctgggcggtgcgccgcgcaccgtggcgattgccaacggcacgctggccgccgccgtcgggctgggcctgcaactgtggattcccggcgtggtgctgtggatcgccggccattcgctggcggtgtggggtgctcgtgtcgatccgcagttcatgcaggtcttcgctcggcacatcaagcacaagccgctactggacgtatag

SEQ ID NO: 7457 - DNA, 273 bp, Acidovorax sp. JS42
atgaacggcccacacgatggaatacccggcttcgaggtgccgctacatcggtctctgaccgagccgatcctgatgggcggcgctccgcgcaccgtggccatcaccaacggcaccttggccgctgccgtgggcctgggcttgcagatgtggattcctgggctggtgctttggatcgtcggccattcgctggcggtctggggtgcgcgtgtcgatccgcagttcatggccgtgttcgcgcggcacatcaagcaccggccgctgctggacgtgtga

SEQ ID NO: 7458 - DNA, 285 bp, Polaromonas naphthalenivorans CJ2
atgagcaccgagaccgaatttgcacagggcttcgccagtggtttcgagattccgctgcatcggtccttgaccgaaccgatcctgctgggcggcgcgccgcgcaccgtggcgatcgccaacgggacgctggccgccgccgttggtctgggcctgcaactgtggattcccggcctggtgctgtggatcgtcggccattcgctggcggtctggggtgcacggctcgatccgcagttcatggccgtgttttcacggcacatcaaacatcgcccactgctggacgtgtaa

SEQ ID NO: 7459 - DNA, 264 bp, Bradyrhizobium BTAi1
atggacggacagatcccaggatttgaagcaccggtccatcgcgcgctgaccgagccgatcctgatgggcggggcgccacgctcgatcgccatcgttaacggcacgctcgctgctgccctcggtattggtctgcgcctctgggtcgcgggcctcctgctttggttcgttggtcacatggtcgctgtctgggtgaccaagcgcgaccctgcctttgtcgaggtcgtccgccggcatctccggatccccggttatctcaacacatga

SEQ ID NO: 7460 - DNA, 270 bp, Bradyrhizobium BTAi1
atggagcaagatggcgccatcgccggcttctatgcgcccgttcaccgagcgttgaccgagccgatcctcttgggcggcgcgccgcgcgccgtggcgatcgtgaacggcacgcttgctgccgcgatcgggctcggtcttcggctctggatcgtgggcggcctcatctggcttgtcggtcacatcgccgccgtttgggcggcgaagcgtgacgccgccttcgtcgacgtcgtgcgtcggcatctgcgttatccgcagcacatggtctcgtga

SEQ ID NO: 7461 - DNA, 501 bp, Bradyrhizobium BTAi1
gtgggagcagccgcttcagcagatcctgcaatcgatcgaaggcccggtggccaaggtcatcgcggtgatcatcatcatcgtcactggcctgacgctcgccttcggcgatacgagcggcggcttccgcaggctcgtgcagatcgtctttggcctgtcgatcgcattcgcagccagctccttcttcctgagcttcttcaacttcggcggtggggcggtggtgtgatggctggtgtgcttgagaccgccgaggtccccggcttctcggtgccagtccatcgggcgctgaccgagcccatcctcctcggcggcgcgccgcgctcgatcgccatcctcaacggcacgctcgccgccgcgctcgggctcggcctgcggctctggctcgtcggcctcggcctttgggccgtcggccatttcgcggcggtgtgggcggcgaagcgcgatccgatgttcgtggaggtcacgcgccggcacctgcgcattcccggcttcctgggcgtgtga

SEQ ID NO: 7462 - DNA, 282 bp, Sphingomonas wittichii RW1
atgacgggcgcggccgatcccgtcgagccgatcgccggctatttcgcgccggtccatcgggcgctgaccgagccgatcctgctcggcggcgccccgcgctcgctggcgatcgtcaacggcacgctggcgggcgcgatcggcctcggcctgcggctctggatcgccggactggcgatttgggccatcggccatgcgctctccgtatgggccgcgcggcgcgatccgcagttcgtggacgtggcccgccggcacctccgctatccggcgtggatgcggccatga

SEQ ID NO: 7463 - DNA, 273 bp, Pseudomonas aeruginosa PA7
atgagcgccccggacaccttcgcggatggattcgaggtgccgctgcaccgctcgctgaccgagccgattctgctgggcggtgcgccgcgcaccgtggcgatcgccaacggcacgctggccgccgctgtcggcctgggactgcaactgtggattcccggcatggtgctctggatcgtcggccattcgctggcggtgtggggcgctcgtgtagatccgcagttcatggccgtgttcgcgcggcacatcaagcaccgcccgctgctggacgtgtga

SEQ ID NO: 7464 - DNA, 282 bp, Ochrobactrum anthropi ATCC 49188
atggcggtgagtttcgaggcgctcgacgcggttccgggattcagtgtgccggttcaccgcgccctgaccgaaccgatcctgcttggcggagcgccacgctccgtcgcgatcctcaatggcacgctggccggagccgtgggcctcggcctccagctctggctggccggcatcctgatctgggccgtcggtcacatcgccgccgtctgggccgccaagcgcgatccgctcttcgtcgaggtcgcgcgccgccacctccgcatccccggtcatctttcggtgtga

SEQ ID NO: 7465 - DNA, 282 bp, Parvibaculum lavamentivorans DS-1
atggcggcggcgttcgaacaactcgacgcggtgccgggtttcaccgtcccggttcaccgggcgctgaccgagcacattctgctcggcggcgcaccgcgcgcactcgccatcctgaacggcacgctggccggagccgtgggccttggcctgcgcctctggctcgtcggtctgctgatctgggccattggccatatcgcagccgtatgggctgcaaagcgcgatcccctcttcgtcgaggtcggtcgccgtcacctgcgcatccccgctcatctgtccgtctga

SEQ ID NO: 7466 - DNA, 273 bp, Xanthobacter autotrophicus Py2
atggcgggcgatgccggcgaggtgccgggcttctccgtcccgatccatcgggttctgagcgaaccgatcctgctcggcggggcgccgcgggcgctcgccatcttcaacggcacgctcgccggtgctgtcgggctgggcctgaggctgtggctcgtgggcctggcgctctgggcgattggtcatctcaccgccgtctgggcggccaagcgcgatccgctcttcgtcgacgtggtgcgtcggcatctgcgcatctcctcccacctatcggtctga

SEQ ID NO: 7467 - DNA, 282 bp, Xanthobacter autotrophicus Py2
atggcgagcctgatcgacagcgccggcgaagtgccgggttatgccgttccggtccaccgggcgctcaccgagcacatcctgctcggcggcgcgccgcgctccatcgcgatcctgaacggcacgctagcggcggcgctcggccttggcctgcgcctctggctggtcggtctcgggctctgggcgatcgggcatttcgccgccgtgtgggcggccaaacgcgatccgcaattcgtcgacgtggtgcgccgtcacctgcgcattcccggccatctgagcgcgtga

SEQ ID NO: 7468 - DNA, 282 bp, Xanthobacter autotrophicus Py2
atggcgagcctgaccgacagcgtcggcgacgtgccaggcttcgccgtcccggtccatcgggcgctcaccgagcacatcctgctcggcggcgcgccgcgctccatcgcgatcctcaacggcacgctggcggcggcgctcggccttggcctgcggctctggctggtcggtctcgggctctgggcgatcgggcatttcgcggcggtgtgggcggccaaacgcgatccacaattcgtcgacgtggtgcgccgtcacctgcgcatccccggccatctaagcgcgtga

SEQ ID NO: 7469 - DNA, 273 bp, Xanthobacter autotrophicus Py2
atggcgggggtggccgacgacgtgccgggcttcaccgtggcggttcacagagcactgtccgagccgatcctgctcggcggcgctccgcgcgccatcgccatcatgaacggcacgctggccggtgcgctcggcttgggcctgcgcctctggctggtcggcctcatcgtctgggccatcggccatttcgcggcggtgtgggcggccaaacgcgatccgctgttcgtcgatgtcggccgccgacacttgcgcatccccgcgcacctctcggtttaa

SEQ ID NO: 7470 - DNA, 273 bp, Xanthobacter autotrophicus Py2
atgccgggcgatattggcggggtgccgggcttctccgtcccggtccatcgggccttgagcgagccgatcctgctcggcggcgcgccgcgggcaatcgccatcttcaacggtaccctcgccggtgctgtcgggctggggctgaggctctggcttgtggggctcgcggtcggggccgtgggccatctcgccgccgtctgggccgccaagcgcgatccgctcttcgtcgatgtggtgcgccgccatctgcgcatccccggtcatctgtcggtctga

SEQ ID NO: 7471 - DNA, 273 bp, Delftia acidovorans SPH-1
atgagtgcccctgacaccttcgcggacggcttcgaggtgccgctgcatcgctcgctgaccgagccgattctgctgggcggtgcgccgcgcaccgtagcgatcgctaacggcacgctggccgccgctgtcggcctgggcctgcaactgtggattccgggcgtcgtgctctggatcgtcggccattcgctggcggtgtggggtgcgcgcgtcgatccgcagttcatgcaggtcttcgcccggcacatcaagcaccgcccgctgctggacgtgtga

SEQ ID NO: 7472 - DNA, 273 bp, Delftia acidovorans SPH-1
atgagtgccccggacaccttcgcggccgggttcgaggtgccgctgcatcgctcgctcaccgagccgatcctgctgggcggcgcaccgcgcaccgtggcgatcgccaacggcaccttggccgccgctgtcgggctgggcctgcaactgtggattcccggtgtcgtgctctggatcgtcggccattcgctggcgatgcggggcgcgcgcgtcgatccgcagttcatggccgtgttcgcgcggcacatcaagcaccgcccgctgctggacgtgtag

SEQ ID NO: 7473 - DNA, 285 bp, Burkholderia multivorans ATCC 17616 JGI
atgagcgccgccaacgaaggagcgccgggcttcgcgtccggattcgagatcccgctgcatcgctcgctgaccgagccgatcctgctgggcggtgcgccgcgcaccgtggcgatcgccaacggcacgctggctgccgccgtcgggctgggtctgcaactgtggattcccggtgcggtgctctggatcgtcggccattcgctggcggtctggggcgcgcgtgtcgatccgcagttcatgcaggtcttcgctcggcacatcaagcacaagccgctgctggacgtatag

SEQ ID NO: 7474 - DNA, 285 bp, Caulobacter K31
atgaccgggccggccacctcttcaggcgtgggggtctcgggtttcgagatcccgctgcatcgggcgctgaccgccccgatcctgctcggcggcgcgccgcggtcgatcgccatcctcaacggcaccctcgctggagccttgggccttggtctccagcaatggatcccaggtctggtggtgtgggtgatcggccatagcctggcggtgttcgccgccaagcgggatccggacttcgcgccggtcctgatgcgccacctgcgccagaaggggtggctacgatgctga

SEQ ID NO: 7475 - DNA, 282 bp, Caulobacter K31
atggcgggcatggtcgaccatgcggccgaggtgcccggcttttccgtgcccgtccaccgggcgctgaccgagcacatcctgctcggcggcgctccgcgcgccattgctatcctcaacggcacgctggcggcagccctcggtctcggcttgcgcctttggctcgtcggccttggcctctgggccctcggccatttcacggccgtctgggcggccaaacgcgatccgatgttcgtcgatgtggtgcgccgtcatctgcgcatccccggtcatctcggcgtctga

SEQ ID NO: 7476 - DNA, 273 bp, Methylobacterium populi BJ001
atggcggacgccgccgacgaagtgccgggcttcaccgtgccgattcatcgggcgctgaccgagccgatcctgcttggcggcgcaccgcgcgccatcgcgatcatgaacggaacactcgccggcgcagtcggcctcggcttgcggctctggctggtcggtcttgcgatctgggccatcggccacttcgcggcggtgtgggcggccaagcgcgatcccctcttcgtcgatgtcggccgccgccatctgcgcatccccgcgcacctcacggtctga

SEQ ID NO: 7477 - DNA, 285 bp, Ralstonia pickettii 12J
atgagcgcggcccacgatggcgtgcaggggttcgctccggggttcgaagtgccactgcaccgctcgctgaccgagccgatcctgctgggcggcgcgccgcgcacggtggcgattgccaatggcaccttggccgcggccgtgggcttgggcctgcaactgtggattccgggcctggtgctctggatcgccggccatgcgttggcggtctggggcgcgcgtgtcgatccgcggttcatgcaagtcttcgcgcgccatatcaagcaccggccgctgctggacgtgtag

SEQ ID NO: 7478 - DNA, 252 bp, Prosthecochloris aestuarii DSM 271
atgagcgaagagtattccgtgccggtacaccgctcgcttgcggaagtgatccttatcggcggtctgccgagaactgtggcaatactgctgtggacgacagccggggcagcaggtttcggcatgcagcagctctgggtattgccggtggccatcgtgctccatgtcgtccttgccatgacggcaaagcgtgatccgcattttttcgatgtctttgtgcgggcgctgaaatcccccaaacgtcttgatccatag

SEQ ID NO: 7479 - DNA, 267 bp, Gluconacetobacter diazotrophicus PAl 5 JGI
atggagccggacagcattcccggcttcaccgccccggtgcatcgcgccctgatcgagccgatcctgctcggcggcgcaccgcgcacggtggccatcgtcaacggcacgctggccgccgccatcgggctcggcctgcggctctggatcgcaggcggcctcttctggctggtgggtcatttcgccgccgtctgggcggcaaaacgcgatccggccttcgtcgatgtggtgcgacggcatctgcgttaccccacccatctggtcgggtga

SEQ ID NO: 7480 - DNA, 276 bp, Gluconacetobacter diazotrophicus PAl 5 JGI
atggccgcgatcgtcgatcccgacgtgcccggcttcttcgcgccggtccatcgcgcgctcaccgacccgatcctgatgggcggcgcgccgcggaccgtcgcgatcgccaacggcacgctcgcggcggcgatcgcgctcggcctccgtctctggatacccggcgcgctcatctgggccgtcgggcacgccgcagcggtctgggccgcaaagcgcgacccgcagttcgtcgacgtggttcgccgtcaccttcgctatcccgcacatctgggggtctga

SEQ ID NO: 7481 - DNA, 273 bp, Thioalkalivibrio HL EbGR7
atgagcggcccggacaccttcgcggccgggttcgaggtgccgctgcatcgctcgctcaccgagccgatcttgctgggcggcgcaccgcgcaccgtggcgatcgccaacggcacgctggccgccgccgtcgggctgggcctgcaactgtggattccgggcgtggtgctctggatcgtcggccattcgctggcggtgtggggtgcgcgcgtcgatcctcagttcatggccgtgttcgcccggcacatcaagcatcgcccgctgctggacgtgtga

SEQ ID NO: 7482 - DNA, 300 bp, Agrobacterium vitis S4
atggctgaagggacgagccgtctggacagggtgcgaattcatcgagctctctcacggccggccctgctgttcggggctgaccgcgagctggtcctgatgaccgggctgactgcggtcatcctcattttcgtggttctgacgctcgtctccgccgcggtcggcttcatcatctggattgtcgtcgtcggtctactgcgcatgatggcaaaggccgatccactcatgcggcaggtctatctccgccacatgaagtaccgctcccactaccggccaacctccagcccatggaggaagcactga

SEQ ID NO: 7483 - DNA, 273 bp, Diaphorobacter TPSY uid29975
atgagcggcccggacaccttcgcggccgggttcgaggtgccgctgcatcgctcactgaccgagccgatcctgctgggcggtgcgccgcgcaccgtggcgatcgccaatggcacgctggccgccgctgtcggcctgggcctgcaactgtggattcccggtgtcgtgctctggatcgtcggccattcgctggcgatgtggggcgcgcgcgtcgatccgcagttcatggccgtgttcgcgcggcacatcaagcaccgcccgttgctggacgtgtag

SEQ ID NO: 7484 - DNA, 285 bp, Azotobacter vinelandii DJ
atgagtgcggccaacgaaggcgcgccaggcttcgcgcccggtttcgagattccgctgcatcgctcgctgaccgagccgatcctgctgggcggtgcgccgcgcaccgtggcgatcgccaacggcacgctggccgccgccgtcgggctgggcctgcaactgtggattcccggcgtcgtgctctggatcgtcggccattcgctggccgtgtggggcgcgcgtgtcgatccgcagttcatgcaggtcttcgcccgacacatcaagcaccgcccgctgctggacgtgtga

SEQ ID NO: 7485 - DNA, 255 bp, Geobacter M21
atggccagggaagggtacgaaatccccatccatagaagcctgatccagccgatcctgataggaggagtgccgagaaccatagccctcatcaacggcacgctggtcgccgccttggggctcggcctccactccctccttgccgttccggtggggttggtgatccattttttggccctggcggccacccgtgccgatcccgaatttctcagctgttttcgtaggcacgtaaggcaaaagaacatctacacggtatga

SEQ ID NO: 7486 - DNA, 312 bp, Bacillus cereus ATCC 10987
atggggcattgtgaaggcagtgagataaatcctaaaatggttcctcgaacagaagaagaaattcaaaatgttataaaacgtttaaaacgtattgaggggcaagtacgtggtgtccaaaaaatggttgaagataatcgttactgtgtagatattttaatccaaatttcagcgattaatgctgctttaaataaggtaggtttttctttattagaacgtcatacaaaacattgcgtagcaaaagcaattaacaaaggggatggagatgaatctattcaagaattaatgagtgtaataagacaattttcaaaatag

SEQ ID NO: 7487 - DNA, 303 bp, Bacillus anthracis Ames 0581
atggatcataaagagcatgaagcagtaacacatagatcagaaaaagaaaaagaacaaattataaatagattaaagagaattgaaggacaagtccgcggtattcaaaatatgattgaaaatgatcgttattgcgtggatattttagtgcaaatttcagcgattaatgcagcgatgaaaaaagtaggaatgggtgtattaaaaaaccatacgagtcattgtgtttcaggtgcaattaaagatggtaatggtgacgaagcaattgaagaattaatgacagtatttgaacgtttttcaaaagcgtaa

SEQ ID NO: 7488 - DNA, 303 bp, Bacillus anthracis str Sterne; identical to SEQ ID NO: 7487

SEQ ID NO: 7489 - DNA, 303 bp, Bacillus thuringiensis konkukian; identical to SEQ ID NO: 7487

SEQ ID NO: 7490 - DNA, 303 bp, Bacillus cereus ZK
atggatcataaagagcatgaagcagtaacacatagatcagaaaaagaaaaagaacaaattataaatagattaaagagaattgaaggacaagtccgcggtattcaaaatatgattgaaaatgatcgttattgcgtagatattttagtgcaaatttcagcgattaatgcagcgatgaaaaaagtaggaatgggtgtattaaaaaaccatacgagtcattgtgtttcaggtgcaattaaagatggtaatggtgacgaagcaattgaagaattaatgacagtatttgaacgtttttcaaaagcgtaa

SEQ ID NO: 7491 - DNA, 288 bp, Thermobifida fusca YX
atggccgcctacggctaccacgacaacaagcggcagcacctcaaccggctccgccggatcgaaggacaagtacgcggcctccagcggatggtcgaggacgacgcctactgcatcgacatcctcacccagacctccgcggtaacgaaggcgctccaatcctttgccctgtcgctcctcgaggagcacctccaccactgcgtggccaacgccctcgccaacggcggccgcgaagccgaaacgaaggtccgcgaagcgtccgaagcgatcgcccgactggtccgctcctga

SEQ ID NO: 7492 - DNA, 279 bp, Nitrosospira multiformis ATCC 25196
atgcccactgcggtggtacagccggataaggaagcgttgataaaacgcctcaaccgcatcgagggtcaggtacgcggcgtggcgaaaatgatcactgaagaccgttattgcgtcgacattctgaaccaggtatccgcgcttcagtccgcgctcgacgctgtggcgatgcgtctccttgaaaatcatacgcatggctgcatgcagagcgcgatcaagtcgggagacggagacgcagcaatcgatgagctgatgacggtggtgcgcagattcgcccgctag

SEQ ID NO: 7493 - DNA, 366 bp, Anaeromyxobacter dehalogenans 2CP-C
atggcgacgaaggagagcaaggggaccgcggcgctcgccgcctgcgcgtgcgccaccggcgagcacgtcgggccgggcgggcgggccgtggcggtggacgcgggcggcaaggaggcgaacctcaagcgcctgcgccgcatcgagggtcaggtgcgcgggctgcagcggatggtggaggaggggcgctactgcgccgacgtcctcacccagatcgcctcggtgcacgaggcgctgcggtcggtcggtcgcgagctgatgcgcaaccacctgaagcactgcgccacgagcgccatccaggcaggcggccccgaggccgacgcgatgtacgacgagctgctcgacctcatgtaccgccaggtccgctga

SEQ ID NO: 7494 - DNA, 327 bp, Rubrobacter xylanophilus DSM 9941
atgagagaggagggcggcgtgcggcaggggcaggcccacgggtatataaaggcggaccacaaggagaatctgctgctgcggctgcgccggatcgagggccaggtgcggggcgtgcaggggatggtcgagcgcgaggagtactgcatagacatcatcacccagatctccagcctcatcgccgcctcggagagggtggccgcgctggtgctcaaggaccacatggagcactgcgtgcgggcggcaatagaggacggggagcaggccgacaggaagatcgaggagctgaccgccgccgtagagcggttcctgaagctggacaggaggtga

SEQ ID NO: 7495 - DNA, 291 bp, Alkalilimnicola ehrlichei MLHE-1
atggccggctgctgccagcggttgcgtctggatgacggcgcccgggaggatgcacgccagcggctgcgttcggtccgcggccacgtggacggcatcctgaagatgctcgaccacccggacacctactgcgtcgatgtgctgaagcagatcaaggcggtgcagggtggcctggaccgggtcggggggctggtgcttcgcgcccacctacgcgaccacgtcaccacggccaatgagcggggtgatgtggaggagatggtcgaggagctgatggaagtcctcaaataccgctga

SEQ ID NO: 7496 - DNA, 291 bp, Alkalilimnicola ehrlichei MLHE-1; identical to SEQ ID NO: 7495

SEQ ID NO: 7497 - DNA, 348 bp, Arthrobacter FB24
atggactcagcagaagacgccggaccccggaccgtggacgccggaaccgtcccccagcatggctacacctcgaacaaagaggcatacctgcgccggctcaaacgcattgaaggccaggtccgcggcatcgccaggatggtggatgaggacaagtactgcatcgacatcctcacccaggttgcggccgtgaacaaggccctgcacgcagtgagcctgggcctcgtcgaggagcacatcggtcactgcgtcgtgggtgccgcctccgaaccggacccggaactccgcgcggaagccatcgacttcaaggtcaaggaggccaccgatgccatcgggcgcctgctgcggtag

SEQ ID NO: 7498 - DNA, 282 bp, Acidothermus cellulolyticus 11B
atggttggctacgccggcacgaaagagacggtcctcgcccggttgcgccggatcgagggccaggttcgcggcctgcaccgcatggttgagcaggacacctactgcatcgacgtcctcacccagatctcggcggcgacccgggcgctggaggccgttgcgctcaacctgctggaagagcacctccgccactgcgtccacgacgccatcaccgccggcggaccggaggctgaggagaagatcactgaggcggccgacgccatccgaaggctcgttcgatcctga

SEQ ID NO: 7499 - DNA, 294 bp, Mycobacterium vanbaalenii PYR-1
atggatacgaagacacccgggtatgcagcctcgaaggacgcacatctcaagcgactgcgcagaattgaggggcaggtccgtggccttgcgcgcatggtcgacgaggacgcctactgcattgacgtgctcacccagatatcggcggcaaccaaagcgttggagtcggtggcgttgtcgcttctcgacgaacatctgtcccattgcgtccgtgacgcagtccaccagggcggcgacatcgccgagcagaagatcgatgaagcctcggcagcaatcgcgcgtctcgtccgttcctga

SEQ ID NO: 7500 - DNA, 333 bp, Desulfotomaculum reducens MI-1
atggatcaaatagaaaaaacaccttgtgtaggttgtcagggaaatgcaaccaataatcgactaagccatcacgacgagagaaccattaaggaacttgtaaatcggattaatcgcatagagggacagttacgtggtattaagggaatgattgagagacatgtttactgtgatgaaatattaaatcagatttcttcggctaatgctgctttacacggggtagctaaattgttgctggagaaacacatgaaatcctgtattttagaacaactacaggagggtgacgaacaggtcattgatgaagtactgaaaactatttttaaaatgatgagataa

SEQ ID NO: 7501 - DNA, 312 bp, Salinispora tropica CNB-440
atggtccgcatgaccagacccgaacccgctccggtccgcggctacaccgccaccaaggaccagctgctcacccggctgcgccgggtcgaggggcaggtccgggggatcgagaagatggtcgaggaggatcggtactgcatcgacgtcctcacccagatcgccgcgatccaggccgcgctggacaaggtggcgctcgggctactcgacgggcacgcccgacactgcatgcgcgagggggccgccgaggggcgagccgacgagatggcgaccgagatgatggccgccgtcggccgactgatgaagcgcggctga

SEQ ID NO: 7502 - DNA, 282 bp, Kineococcus radiotolerans SRS30216
atggtcggctacgacacccacaaggacgaggtcctcaagcgcctgcgccggatcgaggggcaggtccgcggcctgcaccgcatggtcgaggaggacacctactgcatcgacgtcctcacccaggtgtccgcggccaccaaggcactgcaggcggtggccctgtccctcctcgatgaccacctagcgcactgcgtcgccgacgccgcccgtcaaggcggtgaggtcgccgacgccaaggtgaaggaagcctccgacgccatcgcccgcctcgtgcgttcttga

SEQ ID NO: 7503 - DNA, 171 bp, Bacillus cereus cytotoxis NVH 391-98
gtgaatcaagaaaagatggtacctagaacagatgaagaaattgaaaaagttgtaaatcgtttaaaaagaattgaaggccaagtgaggggcattcaaaagatgatggaagataatcgctattgtattgatgtattcattcaaatttctgcagtgcaaagcaacgttaaataa

SEQ ID NO: 7504 - DNA, 303 bp, Salinispora arenicola CNS-205
atgaccacgcccgcacccacccccgtccggggctacaccgccaccaaggaccagctgctcacccggctgcgccgggtcgagggacaggtccggggaatcgagaagatggtcgaggaggatcggtactgcatcgacgtcctcacccagatctccgcgatccaggccgcactggacaaggtggcgctcgggctgctcgacgggcacgcccggcactgcatgcgcgagggggccgccgagggccgggccgacgagatggcaaccgagatgatggccgccgtcggccggctgatgaagcgcggctga

SEQ ID NO: 7505 - DNA, 303 bp, Bacillus weihenstephanensis KBAB4
atggatcataaggaccatgaatcagtaacacatagatcagaaaaagaaaaagaacaaattataaatagattaaagagaattgaaggccaagtccgtggtattcaaaatatgattgaaaatgatcgttattgcgtggatattttagttcaaatttctgcgattaatgcagcgatgaaaaaagtaggaatgggtgtcttaaaaaatcatacgagtcattgtgtttcaggagctattaaaaatggtaatggtgacgaagcaattgaagaattaatgacagtatttgaacgtttttcaaaagcataa

SEQ ID NO: 7506 - DNA, 366 bp, Anaeromyxobacter sp. K
atgggaacgaaggagagcaaggggaccgaggcgctcgccgcctgcgcctgcgccaccggcgagcacgtcgggccgggcgggcgggcggtggcggtggacgccgcgggcaaggaggcgaacctcaagcgcctgcgccgcatcgagggccaggtgcgcgggctgcagcggatggtggaggaggggcgctattgcgccgacgtcctcacgcagatcgcctcggtgcacgaggcgctccgggcggtcgggcgcgagctgatgcgcaaccacctgaagcactgcgccacgaacgccatccaggccggcgggcccgaggccgacgccatgtacgacgagctgctggatctcatgtaccggcaggtccgctga

SEQ ID NO: 7507 - DNA, 303 bp, Bacillus cereus AH187
atggggcataaagagcatgaagcagtaacacatagatcagaaaaagaaaaagagcaaattataaatagattgaagagaattgaagggcaagttcggggtattcaaaatatgattgaaaatgatcggtattgcgtggatattttagtgcaaatttcagcgattaatgcagcgatgaaaaaagtaggaatgggtgtattaaaaaaccatacaagtcattgtgtttcaagtgcaattaaagatggtaatggtgacgaagcaatcgaagaattaatgacagtctttgaacgtttttcaaaagcgtaa

SEQ ID NO: 7508 - DNA, 303 bp, Bacillus cereus B4264
atggatcataaagagcatgaagcagtaacacatagatcagaaaaagaaaaagaacagattataaatagattaaagagaattgaaggacaggtccgcggtattcaaaatatgattgaaaatgatcgttattgcgtggatattttagtgcaaatttcagcgattaatgcagcgatgaaaaaagtaggaatgggtgtattaaaaaaccatacaagtcattgtgtttcaggtgctattaaagatggcaatggtgacgaagcaattgaagaattaatgactgtatttgaacgtttttcaaaagcgtaa

SEQ ID NO: 7509 - DNA, 303 bp, Bacillus cereus G9842
atggatcataaagagaatgaagcagtaacacatagatcagaaaaagaaaaagaacagattataaatagattaaagagaattgaaggacaggttcgcggtattcaaaatatgattgaaaatgatcgttattgcgtggatattttagtgcaaatttcagcgattaatgcagcgatgaaaaaagtaggaatgggcgttctcaaaaatcatacgagtcattgtgtttcaggagctattaaaaatggaaatggtgacgaagcaattgaagaattaatgacagtatttgaacgtttttcaaaagcgtaa

SEQ ID NO: 7510 - DNA, 303 bp, Bacillus cereus AH820; identical to SEQ ID NO: 7487

SEQ ID NO: 7511 - DNA, 312 bp, Bacillus cereus AH820; identical to SEQ ID NO: 7486

SEQ ID NO: 7512 - DNA, 378 bp, Arthrobacter chlorophenolicus A6
atggacgccatcgaagaggccatggccgcgccccccgcggaagcaacgcaggagcgggcaccggaacagtcgcagcacgcagtggaacacgggtacacggccaacaaggacgcctacctgcgccgcctcaaacgaattgagggccaggtccggggtatcgcgcggatggtggacgaggacaagtactgcatcgacatcctcacccaggtttccgccgtcaccaaggccctgcacgctgtcagcctggggttggtggaagagcacatcggccactgtgtggtgggcgccgctgctgaaccggacccggaagcacgcgccgaagccatcgatgccaaagtcaaggaagctacggaagccatcggccgcctgctccgctga

SEQ ID NO: 7513 - DNA, 366 bp, Anaeromyxobacter dehalogenans 2CP 1
atggcgacgaaggagagcaaggggaccgcggcgctcgccgcctgcgcgtgcgccaccggcgagcacgtcgggccgggcgggcgggcggtggcggtggacgcggccggcagggaggcgaacctgaagcgcctgcgccgcatcgagggccaggtgcgcgggctgcagcggatggtggaggaggggcgctactgcgccgacgtcctcacgcagatcgcctcggtgcacgaggcgctgcggtcggtcggtcgcgagctgatgcgcaaccacctgaagcactgcgccacgaccgccatccaggccggcggccccgaggccgacgcgatgtacgacgagctgctcgacctcatgtaccggcaggtccgctga

SEQ ID NO: 7514 - DNA, 282 bp, Beutenbergia cavernae DSM 12333
atgcccggctacagcggaaccaaggcggactacgccaagcgcatgcgtcgcatcgagggtcaggtccgcgggatcgcgcggatgatcgacgaggacgagtactgcatcgacgtcctcacccaggtgtcggcagtgaccaaggcgctccaggcggtgagcctcggactgctcgaggaccacctcggccactgcgtcgtcgacgccgcgcgcgcgggcgacgaggagggcgacgcgaaggtccgcgaggcggccgacgcgatcgcgcggctcgtccgcagctga

SEQ ID NO: 7515 - DNA, 282 bp, Beutenbergia cavernae DSM 12333; identical to SEQ ID NO: 7514

SEQ ID NO: 7516 - DNA, 312 bp, Geobacillus WCH70
atgaatcatcgtgaagagaatcagctcaatccaaaaatggttccgcggacggaagaagaaattgagggcattgtcaagcgcttaaagcgcattgaaggacaagtgcgcggcgtgcaaaaaatggttgaagacaatcgctattgcatcgatattttaatccaaatttccgcaattgaagcagcgttgcataaagtcggattgaatttgctagagcgacacgttcgtcattgcgtcgccaaggcgattcgcgaaggcaacggtgacgaatcgatacaagaattaatgaccgttatccagcagttctcgaaatag

SEQ ID NO: 7517 - DNA, 381 bp, Micrococcus luteus NCTC 2665
atgagcacggacagcacgacgacggcgcccgccgccgcctcgccccttccgtccgccgcggcggacgcctgcgacggccaccggcccccgcacgaggtccaccgggacaaggccaagcacctggcgcgactgcgccgcatcgaggggcaggtgcgcggcctccaccgcatggtggacgaggacgtgtactgcatcgacgtcctcacgcagatcgccgccgtcacgaaggcgctgcagtccctcagcctgaacctcacctcggagcacctgcgtcactgcgtggccgaggccgcggtgcaggccgaggcggaaggccgcaccgagctcatcgacgagaaggtcgccgaggcgacggccgccctcggccgcctgctgcgctga

SEQ ID NO: 7518 - DNA, 306 bp, Kytococcus sedentarius DSM 20547
atggagcactcagagcacgaccaccaccacgggtacatcaccgacaaggaggcctacctcaagcgcatgcgccgcatcgaggggcaggcccgcggcatcgcgcggatgatcgaggaggagaagtactgcatcgacatcctcacccaggtcagcgccgtcaccagcgccctggagggtgtggcgctcgggctgctggaggagcacctgcgcacctgcgtcgtggacgcagcccgcaccggtgatgcggaggccgatgccctggtcaaggaggcgacggcagccatcacccggctggtccgttcctga

SEQ ID NO: 7519 - DNA, 351 bp, Eggerthella lenta DSM 2243
atgaccgagaatcacgcgcaagctgaaaacgccgccatctcgtcgcgccccgcgtcgacgtgctgctgccaccgtaaggagacgccgcgctcggaagagctgcaggccgaccttcatcgtcgcttgaaccgcgtgatcgggcagctgggcggcgtgaagacgatgatcgacgacaaccgctactgcgccgacgtgctcacgcagctggcggccgcggaaagcgcggttcacagcatttccgccgtggtgctgcgcaaccacctggaaacgtgcgtggtcgaacagatcgaacgcggcaacgtggagatcatcgacgaggtcatgaacctgttgaagaagttctcgcgctaa

SEQ ID NO: 7520 - DNA, 276 bp, Chloroflexus aggregans DSM 9485
atggatcctgagcgcaaacagcagattctcaaccgattgaagacaatagagggccacattcgtggtgtgcagcgaatggttgaggaagatgcctactgtatcgatctgctgaatcagacgcgcgcgatccagcaggcgcttgccaagctcgatgcgatcattcttgcgaaccatctacacagttgtgtaacgactgcgatccgcagtgaggatgttggcgagcgcgagcgggtactaaccgagttgttgcaggtgtttgagagtacgcatcgctag

SEQ ID NO: 7521 - DNA, 312 bp, Cryptobacterium curtum DSM 15641
atggcagaacgagagtgtccgcattgtgcgcggcagaagcacacgccgcgcagtcaagacttacaagaagacttacaacgtcgtttgaaccgcgccatcgggcagttgggcggtatcaaaacgatgattgaagaaaaccgctactgcggcgatgtcctggtgcagttgtctgcgacgcgtagtgctattcaaagcatagagcgtattgtgctgcagaatcatttagagacctgcgttgttgaagagatccgatcgggcaacgacgagattgttgatgaagcaatggatctcatcaaacgtgtggcaaagtag

SEQ ID NO: 7522 - DNA, 282 bp, Saccharomonospora viridis DSM 43017
atgccgggatacacctccgacaaggacgcctacctcaagcggctgcgccggatcgaaggacagatccgagggcttcagcggatggtcgaaaacgacgaatactgcatcgacgtactcacgcagatcgccgcggcgaccaaggcgctccaagccgtgtcactggggctgttggaagagcatctccggcactgtgtcgccgaggcgatcagcgagggtggcgagagggccgacgagaaggtccgtgaggccagtgccgccatcgcccgcttggtgcgttcctga

SEQ ID NO: 7523 - DNA, 276 bp, Anaerococcus prevotii DSM 20548
atgcatgctgataagaaaaaaactatcaggaaacttaaaaccgtcggtgggcaaatcgacggtttaattaaaatgattgaagatgataggtattgtatagatatatcaaatcaaattatggcttcaatctctattcttaaaaatataaataaagaagtcctccaagcccatctagaacactgcgtataccagtctttaaatagtgatgatgaggaagatataagacaaaaaatcgaggagatagaaaaagttatcgataaactcaataaaatttaa

SEQ ID NO: 7524 - DNA, 426 bp, Jonesia denitrificans DSM 20603
gtgggtgtattttttcttcttgttctccttgacttaataccccctgggggtatgctaggggtgttggtcaactggccgccgcacgaggaaggcaacgcaatgacaacggaacacatcgacgattccacggtgactgtccccccgtcacgcgggtattccggaacaaaagaggactaccacaaacggttgcggcgcatcgaaggtcaggtgcgaggaatcgcacgtatggtggaagaagacacctactgtattgacgtcctcactcaggtctcagcggtgaccaaagcgctccatgcagtcagtctcggactcttggaagaccacatcgggcattgtgtggtcaacgctgcacaaagttcaccaaccgaagggcaagaaaaagttgctgaagcagccgctgctattgcccgccttgtgcggagttaa

SEQ ID NO: 7525 - DNA, 345 bp, Slackia heliotrinireducens DSM 20476
atgggtgctgagaacacagaggttcaagccgctgccgagcaggcggaacacggttgctgctgcggacgccacaaggatacggaacgctcgcaggagttccaggctgatctgcagaaacgtctgaaccgcgtcatcgggcagctcaacggcgtgaagcgcatgatcgacgataaccgctactgcggcgacgtgctggtgcaactggcggcggccgaggcggccatcaagcgcacgtcggatatcgtcctgcgcgaccacctggaaacgtgcgtgaccgagcagatcaaggccggcaacaccgaaatcatcgacgaggtcatggacctcatgcggaaattcaggtaa

SEQ ID NO: 7526 - DNA, 324 bp, Atopobium parvulum DSM 20469
atggaaacacggagcgcagtagaaaaaaaatcttgtcatcactgcggatataaagcaactcctcgttcgagtgaacttaaaagtggggtttctcgccgtattaatcgtgcaatcggacagcttaacggcattaaaacaatgattaacgaggatcgttattgcggtgatgttcttattcagcttgcagctgttgagtcggcggttaaggccatttcaagagaagtaatgcaggatcatctggagtcttgcgtagttgatcgtatccagtcgggcgacacagaagttattgatgaggttatggacctctttaagcgttttatgtaa

SEQ ID NO: 7527 - DNA, 264 bp, Desulfotomaculum acetoxidans DSM 771
atggaaaacagtaaaaaagatatgttaaacaggctaaaaagaattgagggacaggtacggggtattcataaaatgattgaagaggatcgctattgtgtggatattatgctgcaaatcagcgcaaccagagcagcattgcaaaaggtcgcactgtcactcttaggaaatcacacccgtggttgtgtggccgatgcctttaaaaaagaacggggtgaggaggcaattaaggagcttgtacaggtattggacaaatttatgaattaa

SEQ ID NO: 7528 - DNA, 297 bp, Alicyclobacillus acidocaldarius DSM 446
atgtgccctgaacatgctggatacagctacgcccaacacaagaaagacctcctgcgccggctgcggcgcattgaaggtcaagtgcgtggattgcaaaaaatgattgaagaagatcgttactgtatcgacattctcgtgcagatatccgccatcaagagtgcgcttcaccaagtcgggctcaccattctcgagtcccacacccgtgggtgtgtggcggatgctttggccaaccgagaccagggcgatgaaatggtgcacgaactgatggacgtgatccgtcagttcactcgagcttag

SEQ ID NO: 7529 - DNA, 300 bp, Alicyclobacillus acidocaldarius DSM 446
gtggaagagtcacacgcacatacgcacagctacgagccgatgaaggccgatctcgtccgccgtctgcggcgcatcgaaggtcaggtgcgcgggctgcagaaaatggtggaagacgggcgctactgcgtggacattctcgtccagattgccgccgtgaaaagtgcgctccatcaggtggggctctctatcctggagtcgcacacgcgcggatgcgtggccgaggcgctgcgggagcgggatcgagaagaagaaaaggtggacgagctgattcaggtgcttcgacagttcacgaaattgtga

SEQ ID NO: 7530 - DNA, 336 bp, Moorella thermoacetica ATCC 39073
atgacgccgtccggagaaaagactttacggggtgttcgcttcttgaatgaagtagagcgcggcactgccttcctggccgataaagtgcaacaactgattaccaccatcgaaaaagctaatgtcgcggagtgggttgaactttaccgccggccaggccggctgctttacttgaacttcgccgctggcatagcccggggcctggggatcgccgttggtttcaccatcctgggcgccattgtaatctacattatccgcgagctggccctgttgaacctgccggtcatcggcaaactcattgccgagatcgtacgcatggtccagcaggaggtgtattag

SEQ ID NO: 7531 - DNA, 318 bp, Syntrophomonas wolfei Goettingen
atgccagaaagggaaccgggtcgggatgatagccattaccttcaggaattaaaccggaagatggacgaactatctttgaatatggagaaattgggcattgctgagtatctggaaatgcttagaaatccgcgccgcctcttttttataaatttttgggccggcttatcccgcggctttggaatggctataggttttaccattctggcagctatagtaatatattttttgcaaaagttgattatactaaatgtaccgctaattggagattttattgcggatctggtagcaatagtacaaaaccagctaagggtgcaatag

SEQ ID NO: 7532 - DNA, 312 bp, Thermoanaerobacter sp. X514
ttgaataaagacgaatataaaaacaataataatattatgttaactgcaataaaaaagcagttggaccaaatgtcagagatgatggagaagatgaaaattgctgattacgtcgaacttatgcaaagcccttataggcttttgtggctaaactttataggcggggtagcaagaggttttggaatagcagtaggctttacaatacttggtgcgataattctttatattcttcaaaaactagtggtgttaaatttgcctgtgattggcagtattatagcggatatagttaagattgtaaatcaaaagctatattag

SEQ ID NO: 7533 - DNA, 303 bp, Candidatus Desulforudis audaxviator MP104C
atggccagggaagctgacaaccgggttttgtgggagctcaaactaaaagtccgccagctgagcgtggccatggaaaagatgcggctggctgaatacgtggcgctgctcgaccggccctaccgcctgttgtacatcaactttctcaccggcatcgcgcgggggctcggcatcgccgtcggcttcaccatcctgggcgcggtggtggtgctggttctccagcggctggtgacgctgaacctgccgctgatcgggggctttatcgcggatatcgtccgtgcggtggagatcaacctggcccgctaa

SEQ ID NO: 7534 - DNA, 303 bp, Natranaerobius thermophilus JW NM WN LF
ttgcaagataacaataataatcaaaaagagttgttagaaaaactatattaccaaactgcagaacttttagataaactggaaaaatttaaattagccgagtatatgcattatttaaataatccagtacgttatttttggattaatttttggggaggggtagctagaggtttaggcatagcagtggggatgacagttttaggtgctattttggtttactttttacagcagctagtaatgttaaatctaccaataattggtgattttattgctgatatcgttaaaattgttcaagaacacttataa

SEQ ID NO: 7535 - DNA, 378 bp, Desulfitobacterium hafniense DCB 2
ttgacggcctccaaaaagaaagttagacatgcaaaagaagatccagaacgcattggccaagggaccgatgaagcccggctgcccaataatgagccgctggattgggacgagctgcgggataaggtaacggaactttatctggtactggaaaggatcaatctcaccgaatatattgcctatctcaacaacccccggcggctgctttggcttaattttggcgtggggctggttaaaggcttgggaggtgccatcggggctactctcttgctgggcctgctggtgatgtttttgaggcgtctggttttacttaaccttccggtgatcggcggagtcatcggcgaaatcgtcaagctcgtcaatgcccataatggatattag

SEQ ID NO: 7536 - DNA, 288 bp, Halothermothrix orenii H 168
atggtaactgaagatgataaaaaggaaatcatggaaaaactggatgagatatctgacaggttgcagaagttgaatatagctgaatatattgagcttgttagatctccaaggagaatgcttttaataaattttatagcaggactggccagaggtctgggggtggctataggtgctacttttctcggggcaatatttttagttattttatttaggcttgcccggttaaacctgccgttaattggagaatatatagccaggattgtgaaaatagttcagacatatctctaa

SEQ ID NO: 7537 - DNA, 303 bp, Clostridium cellulolyticum H10
atggccaacaaaaatcatttatttagtgtgctgtgcaaaaaaattgataatttgtctctgaaaatggaaaagatgaagtttgtggattatgtttattatcttgaacatcctaggaaaatgctatgggccaattttgtaagcggtttggcaagaggctttggaattgctattggattcactattcttggagcaattgccatttactttcttaatattattgttaaaataaaccttccatatattggagaatttatcagtgatatagttaagattgtgcaaaacagcagtcggaatgtcagatga

SEQ ID NO: 7538 - DNA, 279 bp, Anaerocellum thermophilum DSM 6725
atgtcaagagacgaatttgaagaaaagttaaatgattttatcttaaaacttgaaaggatgaattttagttactatatagaatatttgaaaaacccaaagaagataatttttacaaactttttatcgggtgctgcacggggatttggaacagcttttggcttttctattttgggtgctcttcttttatatatacttaacgctatcgtaaagtataaccttcctgtaattggccgatatattgctgaaatattgaaatttgtaaagttttatatgcattaa

SEQ ID NO: 7539 - DNA, 297 bp, Desulfotomaculum acetoxidans DSM 771
atgcacatagaaaataccttaattaaatccctggaaaaaaagttggataaattatcacttgatatggagaaaatgaaactggccgagtacgtggatttgctcgaacataccaaaaaactgttatatataaattttatttccggggtggccagaggcctgggcatagcagtaggttttaccgttttgggtgcacttttgatttatctgctgcgttggctcttagtgctcaatattcctgtaataggaggctttatcgctgaaatcataaaaatagtgcagcttcgtttaggcagctaa

SEQ ID NO: 7540 - DNA, 315 bp, Alicyclobacillus acidocaldarius DSM 446
atgcggcatcggcgcagacggcgtcactcgctcacacacctcggactgctgagactgacggaatacctcgaaggtgtgaacttcgcggcgtacgtcgatctgctgcagaccccgtggcggctcgcgctgctcaatctcatcggcggcatctttcgcggcctgggcatcggcctgggtttcaccgtgatcgcaggtttggtggtgctcatcctgcagcagctcgagcttctcaatctcccgatcatcggcaagtggatcgcggatttggtccaaatcgtggacgggcagctcagggcacgccagttcacgtactga

SEQ ID NO: 7541 - DNA, 420 bp, Frankia CcI3
gtggtagatcctcgtgggatgcggttcgccgctgccgtcaccacgatcatgctcgccgtgatactgctcgccggcagccgctggttgctgctcgcgcagaccgtggtgttcggggtgggggcggtggccggggtccggcacgcgccctacgggctggtgttccgttccctgatccggccgaggctggggccgccggccgccaccgaggacgccgcgccgccccggttcgcccagctggtcggcgcgatcttcggcgtcgtgggtctcgtgggattcttcgcggggatgccggcactcggttacgtcgcggtggccctggccttcgtggcggccctcctcaatgcggcgttcgagttctgtctcgggtgccagctgtatctttttctccattcgatagccgtgaaaggagcacgcacatga

SEQ ID NO: 7542 - DNA, 471 bp, Mycobacterium MCS
atgtccacgtcgacagacaccgcgtcggacccccgggtcgacgtccgcggtccccggttcgccgcctgggtgaccaccggcgtgctggtcgcgacgctggtgctctccgcggtgagtccgctcgcggcggcggtcctgctcggcgcgcagaccgtcgtcttcgcgatcggcgcacgacgcggtccccgccggcacccctacggcatcgtgttcgggcgggtgatcgcgccccgactcgggccggtcaccgaccgcgaaccggcgggccccttgaagttcgcccagctcgtcggcttcgtcttcgccgccgtcggcaccatcggattcgccgcggaatggtccgcggtcggtctcatcgccaccgcgttcgcactgttcgcggcgttcctcaacgcggccttcggcatctgcctgggctgcaagctctacccgctcgcagcccggctccgccgggttcccacccccgcatga

SEQ ID NO: 7543 - DNA, 486 bp, Nocardioides JS614
atgtccaccacccagcagcaccaccaggccgaccaggcccagcgtccggccgagcggcgaccggccggcatcgacccccgcggcccccagttcgccgcggccctcacctcgatcgccctgatcgtggtcctcctgctcgcccccggcccggccgcggtcgtggtgctggccctccaggccgcggtgttcgccgtgggggccacccgcggcgtgcagcacacgccgtactcctggctgttccgcaccctggtccggccccgcctcgcggtgccggaccacctggaggacccggccccgccgcggttcgcccagaccgtcggcctcggcttcgccgtcgtcgccctggtcggcttcctcgccggcgtcgacctgctcggcctggtcgcgaccggcttcgcactggtcgccgccctgctgaacgccctgttccgcttctgcctcggctgcgagctgtacctgctcggccgccgcatcaccgcgcactga

SEQ ID NO: 7544 - DNA, 471 bp, Mycobacterium KMS; identical to SEQ ID NO: 7542

SEQ ID NO: 7545 - DNA, 462 bp, Mycobacterium vanbaalenii PYR-1
atgtcgaacatcacacagagcagcgcgccgacgcagatcgacgttcgcggcccgcgcttcgtcgcgtgggtgaccaccgtcgtcctcgtcgccaccctgctcgtgtcggcgcagcacccggcggcagcagccgtgctgctcggtgcgcaggccgtcgtcttcgcgatcggcgcggtgtcgggtccgcgccggcatccgtacggccgggtgttcgccgcactgatcgcccccaggctggctcctgccaccgaccgtgaaccggtggcaccgctgaagttcgcgcagctcgtcgggttcgccttcgccgttgtcggcgtcctcggtttcgccagtggtctcgcaccgctgggcctggtcgccacgggtttcgcgctcgtggcggcgttgctcaacgcagccttcggtatctgtctgggctgccagctctatccgctcgtcacacgcttgaaccccacccgctag

SEQ ID NO: 7546 - DNA, 471 bp, Mycobacterium JLS; identical to SEQ ID NO: 7542

SEQ ID NO: 7547 - DNA, 462 bp, Mycobacterium gilvum PYR-GCK
atgtcgaacatcacagccgcggactcacccgcgcaggtcgacgtccgcggtccgcggttcgtcgcgtgggtgacgacggcggtgctggtcgcagcgctgttgatctcggtgcagaacgcggccctggccgctgcgctcctcggcatccagacgttggtcttcgcagtcggcgccgtcgccggcccgcgccgacacccctacggagtcgccttcgccgctctcatcgccccccgtctcggacccgcccgggagcgtgaacccgtcgcgccgctgaagttcgcgcaactcgtcgggttcgtgttcgcggcgctcagcaccctcggtttcgccggcggcgtgatgccgctgggcctgatcgcgacgggcctcgcgctcgccgccgcactgctcaacgcagccttcgggatctgtctcggctgtcagctctacccgctcatcgcacgcttgacccccaccccgtag

SEQ ID NO: 7548 - DNA, 420 bp, Frankia EAN1pec
atggtggatccacgcgggccgcgtttcgctgcggccgtgaccactgttgtactcgccgtaacgatcattaccggtaatccatggctcctgctcgcgcagaccgtggtcttcctggtcggcgccgtggccggaatccgaaacgccccctacgggctggtgttccgttacctcgtccggccgcggctcggcccgcccgccgagctggaggacgaggcgcccccgcggttcgcccaggccgtgggcgccgtgttcggcgtggtgggaaccgtcgggctgctcgccgggcctgccgcgctgggctactcggcggcggccctcgccttcgccgcggccttcctgaacgcggcgttcggattctgcctcggatgccagacctacctcgtcctacgttccgcaactgtgaagggagcacgcacatga

SEQ ID NO: 7549 - DNA, 435 bp, Actinosynnema mirum DSM 43827
gtgccgaaagacgtccccgtcgatcccaggggagccaggttcagcgcctggttcaccagcgcggtgctggtcctggtgctgctcaccggctcgtggcggctgctggcggcgcagaccctcctgttcgcgatgtgcgccttcgtgtcgctgcggctcaacccgtgggggcacgtgtaccggcgggtcctgcagccccggctgccggaggcggagcgggaggacgcggcgccgctgcggttcgcccagggcgtcgggttcgccttcgcgctggtcggcacgatcggctacgcggcgggctggacggcgctgggcgtggtggccacctcggccgcgctgaccgcggccctgctgaacgccgcgctggggctgtgcctcggctgcgagctgttcctgctggtccgccgggccgccccggcgcccgcgccccgcacctga

SEQ ID NO: 7550 - DNA, 441 bp, Saccharomonospora viridis DSM 43017
atgtccgcgccggcgtcggtggacccccgcggcccccggttcgcggccgtggtcaccacggtcgtcctcgcgatcgtgctgttcaccgaatggtggccactgctcgcggcccagaccgtggtcttcgcgctcggcgctttcgccggtctccgtttcgccccgtactcggtgctgtaccgcgcgctgatcgcgccgaagttgcggccgacgaccgaacgcgaggacgccgcaccgctacgtttcgcccaggccgtcgggttcgccttcgcactcgtcggaacgatcggctacgcgacggggctgcccacggtgggtgtgatcgcgacggcgttcgccctgttcgccgcgttcctcaacgcggccttcaacctctgcctgggttgcgaggtgtacctgctgctccaacgggtcacaccacggaccaagcgcatgaacgcctga

SEQ ID NO: 7551 - DNA, 450 bp, Clostridium thermocellum ATCC 27405
ttgagtgacggtataataaggaaaaactttgttatacctgcaaatgattttacattggccggggaagcatcaagcaccgtaaagaagatgcttatacagcttggtgctgatccacagaaaataaaaaagacggccatatccatgtatgaggctgaattgaacgccgtcattcacgccaacggcggagtggcggaagttgaaattgacagaaacaaagtctttatacggataaaagatgaaggaccgggaatacctgatttggagctggcaatgcaggaaggatataccactgctccggacagtatccgtgaaatggggtttggtgccggaatgggacttcccaatatgaaaagatatgctgacaagcttgagataataacggaagtaggaaaggggactattgttgagattaccgtgtttttaacggataatgagaaagagaaccattaa

SEQ ID NO: 7552 - DNA, 966 bp, Thermotoga petrophila RKU-1
atgagcgtttccatcatagacagattgcaagccattttccaggatgtcagagtttccgagttcatgaatccggacgttatatacgtaacaccggacaagacacttcttcacgtgaaagagattatgaggataaagaggatctcaggtgtgcccgtagtggatgacaaaaaacgggtagtgggaatcgtcagtttggaagacatcataaaagcccttgagggaagttacataaaagacagtgttgaaaagcgcatgacgaagaacgtggtatgtctgaaagaaacagacaccctccaggacgccgtcaagacctttgagaaatacggttatgggagatttcccgttgtcgacgatgagggaaaacttgtggggatcgtgacaaagcacgacatcatctattttcttctggcaaaactcggcatcatgtatctgcacgacaaaaggatggaagaagtcttggaaaaaggaacctcactgatcacgggagaggtcctggaaaaaggaaaagcggattttgttttccacatagattacttcgatgtgaacatgatcgggataggggcttccaaattgaagaggtttctcttagagcgaggagtggatgaagaactggcaagaagaattgcaatagctacttacgaagcggaagcaaacgttgtcatccacagcgaatccgatgggtacatatactgcttcatcgacaatgagaaaatcacggtgagggtagaagacagaggaaaagggatagaaaatctggaactcgcgatgagagaaggctattcaacggctccagaccacatcagagagctcggctttggtgcagggatggggcttccaaacatgaaaaggtactccgataaaatggtcatcatctcagaagtgggaaagggtgtaatcgttgagatggtgttcttcaggagggatagaggtgaggataagggagatagtggaaaaactggggcttga

SEQ ID NO: 7553 - DNA, 423 bp, Clostridium phytofermentans ISDg
ttgagccaatcaatcacactaacttatacgatacctggtgatgattttactagagcgggggaagcatctagtgatgttaaaaagaaattaaagcagatgggagcaaatccggaggctataagaaaggttgccatctctatgtatgagggcgagataaacatggtgattcatgctcatggaggagatatcacggtacatatctcttctacagaaatcataatgatattaaaagatgagggaccaggaattgtagatgtagaacttgccatgcaggctggatattccactgcacccgataatgttagggcactgggatttggggctggcatgggccttccaaatatgaaaaaatactcagatgaaatgagtataaataccatattgggagaggggactactgtatcgttgaaggtttatatgtaa

SEQ ID NO: 7554 - DNA, 420 bp, Thermoanaerobacter sp. X514
atggtactttatagtttagattttgatgttaaagcgagagattttgattctgcaggagaggtttccagcaatttgagatcagtattaaaacagctttccttaaatccagatgttgtaaggagaagttgcatagcttgttatgaagcagagatgaatataataattcattcttatggaggtcacatgaaaatagaaatttttggcgataaaatacgcataactgcagaagacacaggtcctggaatagaagacattgaacttgccatgaaagaaggatattctactgctcctgaagagataagggaaatgggatttggagccggcatgggacttcctaatatgaaggaaaattctgattttatggatataaaaagcagtaaaaatgggacaactgtggtaatggaaattttatttaagtag

SEQ ID NO: 7555 - DNA, 966 bp, Thermotoga RQ2
atgagcgtttccatcatagacagattgcaagccatcttccaggatgtcagagtttccgagttcatgaatccggatgtgatatatgtaacgccggacaagacacttcttcacgtgaaagagattatgaggataaagaggatctcaggtgtgcccgtagtggatgacaaaaaacgggtggtgggaatcgtcagtctggaagacatcataaaggccctcgagggaagttacataaaagacagtgttgaaaagcgcatgacgaagaacgtggtatgtctgaaagaaacagacaccctccaggacgccgtcaagacctttgagaaatacggttatgggagatttcccgttgtcgacgatgagggaaaactggtggggatcgtgacaaagcacgacatcatctattttctcctggcaaaactcggtatcatgtatctgcacgacaaaaggatggaagaagtcctggaaaaaggaacttcactgatcacgggagaagtcctggaaaaaggaaaagcggattttgttttccacatagattacttcgatgtgaacatgatcgggataggggcttccaaattgaagaggtttctcctggagcgaggagtggatgaagaactggcaagaagaatcgcaatagctacttacgaagcggaagcaaacgttgtcattcacagcgaatccgatgggtacatatactgcttcatcgacaatgagaaaatcacggtgagggtagaagacagaggaaaagggatagaaaatctggaactcgcgatgagagaaggctattcaacggctccagaccacatcagagagctcggctttggtgcagggatggggcttccaaacatgaaaaggtactccgataaaatggtcatcatctcagaagtgggaaagggtgtaatcgttgagatggtgttcttcaggagggatagaggtgaggataagggagatagtggaaaaactggggcttga

SEQ ID NO: 7556 - DNA, 435 bp, Natranaerobius thermophilus JW NM WN LF
atggatgaagaacaagagaagtttatcaagtcttataaattagaaggtcaggactttcaatctgggggtgaagcttcggctcagataaagcaaatactaaaaagcctaggagttccttcaaagattattagaaaagcaactgtgatttcttatgaagcagagatgaatgtaattatccattcatatagcggggaaataattttggatgttgaccagtatcgagtcgtcataaggactgaagatactggccccggtatacaggatattgataaagccatggaagagggttatactacagtgtccaccgaaattttagaaatgggctttggtgccggaatgggtttgcctaatatcaaaaaattttcggacaatctaaaaattaattcacaagttggagaaggaactgtccttgaagctacagtatatattaactag

SEQ ID NO: 7557 - DNA, 873 bp, Dictyoglomus turgidum DSM 6724
ttgaaaattcccaaagaatatcttgagaagataaaggttaaagatattatgaatacagacattgtaaggcttaggccttaccaggatatgcgttctattcaagaaataatgagaattaagagaattgatgctattcctattgttgatgatttagaaaatcttattggtcttgtgactgtagaaaatgtaattaatgccctcgcaaaaggtgatataaatgttccttgtgagaaatatatggtgagagatcctaagtgtttaaagcctgacgataacctttatgaggcgttaataaagtttaggcggtttagatttggaagatttcctgtagtagacgaaaaaggcaaggttcttggaatattgagcacaaaggatatagtattaaatcttgtagatgttgaagatattgagggaataaaggaggaaaagaaagaagaagcggttcttattcttgaatatccagtaatgggtggagattttgccttagcaggagtggcatctagtaatgtgaaaaaagtgcttcaacagcttggaataggtcctgatattataagaaaagttgcggtagtaacctacgaggcagaaatgaatattgtgatacatgcttatagaggagttttaagggtaaaagtgacccctgagtatattgatattgtagctgaggatgaaggaccaggaatacctgacatagaattggctatgcaacctggttattctactgctcccgacaacataagggagatgggatttggagcagggatgggacttcctaatataaagaattcctctgatgagcttcatattgattctatagtgggaagaggaaccacagttcattcaagaatttatttaaagagggaaaggaatgtctga

SEQ ID NO: 7558 - DNA, 420 bp, Anaerocellum thermophilum DSM 6725
atgctgcttgagctggaatttgagattgagccaggtaattttatattagcaggggaagcttcttctaagattaaggagactctaaagaaacttggtgtaaaaccagagatacttaaaaaagttgcaattgtctcttatgaagcagagatgaatattgttatacattctattggtgggattttaaaagctgtaatttcaaaagataagattgaaatagtagctcaagatgatggacctggcattgaagatattgagcttgctatgaaagaaggatattccaccgctccagaagagataagaaacttgggatttggagcaggtatgggtcttccaaacatgaagaagtattcagattattttgagattgaatcacaaaaaggaaaaggtacaagggtatatatggttatttacaataaatga

SEQ ID NO: 7559 - DNA, 429 bp, Desulfotomaculum acetoxidans DSM 771
ttgcagttggaatttgaaattaagggcatggactttgcccgggccggggaagcggcagcaaaaataaaaaaagctctgcaaatggttgggatggaagtcgaaaccatcaggaaaaccttagttgtagcctatgaggccgaacttaatgtagttattcacgcttatgccggtacactgactgcaaaaatcagccctgatgccgtggagataaaggttatggatgagggaccgggtatagccgatattgaactggccatgcaggagggttattccaccgcaccttccaacatcagagaaatgggtttcggagcgggtatgggacttcccaatattgagcgctgctcggatcaaatggaactaacctccgaagttaatcaagggaccctgctcactgccataatattcaacaggacaagtggtgagaaataa

SEQ ID NO: 7560 - DNA, 492 bp, Brucella suis 1330
atgagtgatgcggcacgggaaaaggatggcaaggcgaagggttccatgatgggcctgcttgcggctgtcgccgttctcacggcaattgccggcggtggcggctggtatctgggcaatatgatttccgccgggcaacaggcttccgccaaaccttccggcaaggaagacaagccaaagccgggaagcttcgagtcccgctccatcggtgcggttgtgccgttgcagccgatcatcaccaatctgggcattccacagaccacctgggtgcggctcgaagcctcgcttgtcgccaaacccggccacgaaattccgccggcaatggctgccaatgtcagcgatgatttcatgcgttttctgcgcagcgtcaatctcatgcaattgcagggcgcggcggggcttgcctatctgcgcaccgatctggaagaacgcgcgcgcctgcgttcagaaggcgcggttgaccgtgttttcatctcggcgctggtggtggaatga

SEQ ID NO: 7561 - DNA, 444 bp, Rhodopseudomonas palustris BisB18
atgcaatggctggtggtgtttctggtgctcacggcggtttccgcggcggcgggcgtgctgtcgagcctccatgtgttatccgcggtgcagcacaccgcagacacccagcagaaggtcgagccgccgccggcagcgtcggctttcagcccgagcgcgcggcttcgcaaaatggcgccggtggtgaccaatatggcgtcgccgccgggcgcctggatccgcgtcgaagcctcggtgatcaccgatcaggtcgatgacgaacaggcgaatgtgctgatcgcacgggtcggcgaagacgtcgtgtcgtatctgcgaacgatctcgccgacgcaaatcgagggcgcgcgcggtttgcaatatctgcgtgaggatctcaacgaacgagccgccattcgctcgagcggcaaggtgcgcgaattgatcatcgaaaccttggtggtccaatga

SEQ ID NO: 7562 - DNA, 453 bp, Mesorhizobium BNC1
atgcaggcggcggccctgctggttatgacggcgcttgccggaggcatgggatggctgacaggcgcctatctggaagagcgcagcgcctccggccaatcggaaaacgccgggaaaaccgaggtagccgttcaggaagggcaagagggcaacgagccggataacgagtctctttcgagcatcgttgcgcttgatcccatcaccaccaatctggccgaaccgaccagcatttgggttcgaatggagttggcgcttgtcttcgagggggaaagcgatcccaccctcgcgcgcaccattcatcaggacctattcgcctatatccgtactttgcgactgaagcagatcgagagcgccagcggctttcagcacctgaagtcggatattctcgagcgcgcgcgcatccgcagcgatgaccgcgtgaagcaagtattgatcatgagcttcctatacgaatga

SEQ ID NO: 7563 - DNA, 498 bp, Bartonella bacilliformis KC583
atggataaagagccaaaacaagaagaggcaacagtcaacaaagataatagtgtgaaaacactcttgattgttggacttatcttaacattgattgctggggctgctgggtggtttttaagtttatgggtgagtcaagaaattaggcagacttctggtgcttctaaagactcttcaatcgctattccagcgagtaaaatcatggctgatacccatacggttgttttgcctcctcttgtaacgaatatggcatcaccagaaaaggcttggattcgggtcgaaattgctttgattgttaaatctggtgaaactatttcctcaactgaggtagctaatatatcgagtgattttttagcgtttctgcgtcaaataacaatcgatcaggtgaaggggccatctgggctgatgcatttgcgctcggacctttttgatcgtgctaaaattcgttctggcgataaaatcagcaatattttaatttccaatttggtaatagaacaatga

SEQ ID NO: 7564 - DNA, 492 bp, Brucella ovis; identical to SEQ ID NO: 7560

SEQ ID NO: 7565 - DNA, 492 bp, Sinorhizobium medicae WSM419
atggaagaaatcgagagcaaagaaacgaaatcgccttcgcgggtgatgaccatcgcggcggtggcggcgctgacgctcgtcgccggcggtggcggctggctcgcaggcatgctcctggcaccgcccgcggccgagaagacggaagccgcggtcgagcttccggcgaatgcgaccggcgaggaggaaatagccaggatcgcaacggtcgcgaacggcatcgtgcagctcgatcccattacgacgaaccttgcctatccagccgaaaactgggttcgcctcgaagtcgctcttcagttcaacggcgttcccgacgttgcgttggcggagacgatacaccaggacattgcagcctacctcaagaccgtgtcgctgcagcaggttcaagggccgcgcggcttccaatatctccgggatgacattcaggagcgggttgacctgcgctccgagggccgcgtaacgagtgtgatgttccgcaccttcgtcatccaatga

SEQ ID NO: 7566 - DNA, 495 bp, Ochrobactrum anthropi ATCC 49188
atgagtgatacgacggtaacggaaaaagacggtaaggcgaaaggctccctgacggggctgctggcggctgtcgcggttctgaccgtcatcgcgggcggtggcggctggtatctgggcggcatgatttccgccgatcagctggcatcggccaaaccttccggcaaggaagacaagccgaagcagggcgacttcgaatcgcgttccatcggcaccgtcgtgcccctgcagccgatcatcaccaatctcggcattccgcagaacacctgggtgcgtctcgaagcctcgctggtggcaaagccgggccatgaaattccggcggcggtggcggcaagcgtcggcgatgatttcctgagcttcctgcgcagtgtcaacctcatgcaattgcagggcgcggccgggcttgcctatttgcgctccgatttggaagaacgtgcgcgcctgcgttcggaaggcgctgtcgaacgcgttttcatttcggcattggtcgtagaatga

SEQ ID NO: 7567 - DNA, 483 bp, Methylobacterium extorquens PA1
atggcggacgccaaggactccaagaagggcggcaagggctggatcggggcgctcgccctcgtcacgctgatcgccgtcggcaccgggggcgggctcggcgtctacctgctcggcaccgtcgagaaatcggtcgacctcaagcagcgcgaggaggccggcaaggcggtcaaggtgctcaactacaccggcgacctgtccctgcgcagcgtcggctccgtggtggccaacctcgccgaaccgaccgattcctgggtgcgaatcgaatcctccgtcgtgttcaatacgggcgcgctgcccaatcccgacgtgacgctcgccgagatccgcgccgacgcgctggcctacctgcgcacgctctccttggcgcagatcgaaggcgcgaacggcctccagcacctgcgcgaggacctcaacgagcgcgtcgcgacccgcaccaagggggcggtgcgcgaactcatcgtcgaatcgctggtggtccagtga

SEQ ID NO: 7568 - DNA, 483 bp, Methylobacterium radiotolerans JCM 2831
atggcctcggacaccgtcacacgccgtgcgcggctgcgctggctgctgctcctcgcgctgctcacggtcctggcggtcggcgtcggggcggcgagcggtctccacatgatcgcgcgggtcgagaaggccctcgacgagcggcgaaaggcccaggacgagcaggtgcggccggtgacggcctacgccgagaacgacactctcacgagcctcggcaccgtggtgaccaacctcgcgggccccggcgacgtctgggtccggctcgaatcctccgtgatcgtcaggcccgggaccttcgccaatccccaggccatggtcgcggagatccggcaggacatcgtgggctatctgcgcacgctctcggtcgcgcagatcgagggcccgagcggcctgagccatctgcgggaggatctcacggaacgcgtgcagatccgcagcaacggccagatccgcaccttcttcatcgaaacgctcgtcgtccagtag

SEQ ID NO: 7569 - DNA, 504 bp, Beijerinckia indica ATCC 9039
atggcttctcaagacgtgccggcattgccgtctaacccatcattatcgcaatcaaaactgcaccgcttgggtgtgttggtgggtctgacgcttttcgccggcgctgtcggcgcgagcgtcggctattacctcgttttgtctattaaagcgaaactggcagacaccatgtcgacaattgagaaggagaatagtccgtcgaaattgggcgcaaatgtcaatgcctggcccttacctcccataattgccaatctcgccgatccacccaattcctggatccgattggaaaccgtcatgcttttcgacagcaaaattgtcccaaagccagaagtgctgtccatgcaactcacgacagatgtactcggatatttgaagaccctgtctgtcgcgcagctggctggtccgagcggatttcagaatcttcgcgacgatctcaacgaacgcgctcatatccgatcgaatggcgccattcaggaacttgtcatccaagccttggtgatccagtga

SEQ ID NO: 7570 - DNA, 483 bp, Methylobacterium populi BJ001
atggcggacgccaaggacagcaagaagggcggcaagggctggatcggggcgctcgccctggtgacgctggtcgccgtcggcaccgggggcgggctcggcgtctacctgctcggcagcgtcgagaagtcggtcgacctcaagaagcgcgaggaggccgacaaggcggtgaaggtgctcaactacaccggcgagctgtccctgcgcagcgtcggctccgtggtggccaatctcgccgagccgaccgattcctgggtgcggatcgagtcctcggtcgtgttcaagaccgggacgctgcccaaccccgacgtgacgctcgccgagatccgcgccgacgcgctcgcctatctgcgcacgctgtcgatggcgcagatcgagggcgcgagcggccttcagcacctgcgcgaggacctcaacgagcgcgtcgcgatccggaccaagggcgcggtgcgcgaactcatcgtcgaatcgctggtggtgcaatga

SEQ ID NO: 7571 - DNA, 507 bp, Rhizobium leguminosarum bv  trifolii WSM2304
atggcagagccagacgcaagcgcaggtcaaccgaagaagaaatccggcaccctgatgatgatcatcggcatcgctgtcctgacgctgctcggcgccggcggcggctgggcggtcggcacgatcgtcgcgcccaacatcaagggcgccaaggaggccgagcaggccaaggacgccgaggccaagaaaaaggccgaggaaggcctagcccacatctcgacggaagccaacaacgtcgtccagctcgagccgatcacgtcgaacctcgcttacccctcggaaaactgggtccgactcgaggtcgcgctgctgttcaacggtccaccggatgtcaaggtttccgaggatattcaccaggatatcctcgcctatatcaggaccgtttccctgcagcagatcgaggggccgcggggctttcaatatctcaaggatgacatacaggaacgtgttgaccttcgctcgcaagggcgggtatcgaaggtcatgttcaggacatttgtcatcgaatga

SEQ ID NO: 7572 - DNA, 507 bp, Methylocella silvestris BL2
atgagcacggatgaggactatgatctggaggcggcttcgacccggcccgccggagcgtcattggccgccttcgccggcctgatggcggcattgactattgttgcgatgatatctggcggcgcgcttggagcgcgcctcggcgcggtcgttaagacccaactcgccggcgcgcccgggagcgcgcgcgccgacgcccaatcggcctattcgggcggcgtcaatctgcaggatctgccgccgatcatcgccaatctcgccgagccgtcggacgcctgggttcgattgcaggcgacccttgttctcgaccgcccggcgtcgggcaagccggacgtcctcgccgcgcaaattgccgaagacatcctcggcttcatgcgcaccgcgaccctttcccaaattgcgggggcgagcggccttcagcatttgcgcgaagatctgaacgagcgcgccatgatccgctccgacggccgcgtgcgcgaacttatccttcaaactctggtggttcagtga

SEQ ID NO: 7573 - DNA, 483 bp, Methylobacterium chloromethanicum CM4
atggcggacgccaaggactccaagaagggcggcaagggctggatcggcgcgctcgccctcgtcacgctgatcgccgtcggcaccgggggcgggctcggcgtctacctgctcggcaccgtcgagaaatcggtcgacctcaagcagcgcgaggaggccggcaaggcggtgaaggcgctcaactacaccggcgacctgtccctgcgcagcgtcggctcggtggtggcgaacctcgccgagccgaccgattcctgggtgcgaatcgaatcctccgtcgtgttcaatacgggcgcgctgcccaaccccgacgtgacgctggccgagatccgtgccgacgcgctggcctacctgcgaacgctctccatggcgcagatcgagggcgcgaacggcctccagcacctgcgcgaagacctcaacgagcgcgtcgcgacccgcaccaagggggcggtgcgcgaactcatcgtcgaatcgctggtggtccagtga

SEQ ID NO: 7574 - DNA, 519 bp, Agrobacterium vitis S4
atggcagatgcaccggcgctggaaggcccttcgaaaaaggcttcccccattctgctcattgctgcacttgcgggactgaccgttgtcggtgccggtgccggctggctggtcggcaccatggtagcgcccaaggtgaaggtggcgaaggaagaacaaaaggcggctgaagaggccgggggcaaaaaaaaagaaggcgaaaaagaagagaccggcttgccgaaattgccagcagaggccaatggtatcgtccagcttgatcctgtcaccaccaaccttgcctatccctctgaaagctgggtccggctggaagtggctctggtcttcaacggtccggtcgatgcaaaactggctgaggatattcatcaggatttgatggcctatatgcgcacggtatccctgcaacagatcgaaggcccacgcggtttcgattatttgaaggacgatctgcgcgagcgagttgacgtgcggtctgaaggacgggtatcgaagcttttgtttaggacgtttgtcatcgaatga

SEQ ID NO: 7575 - DNA, 507 bp, Rhizobium leguminosarum bv  trifolii WSM1325
atggcagagccagacgcaagcgcaggtcaatcgcagaagaaatccggcgcgctgatgacgatcatcggcatcgccgtcctgaccctgctcggcgccggcggcggctgggcggtcggcacgatcgtcgcgcccaacatcaagggcgccaaggaggtcgagcaggccaaggatgctgaggccaagaagaaggccgaggaaggcctggcgcgcatctcgaccgaggccaacaacgtcgtccagctcgagccgatcacctcgaacctcgcctacccctcagaaaactgggtgcgactcgaagtcgcgctgctgttcaacgggccgccggatgtcaaggtttccgaggatattcaccaggatatcctcgcctatatcaggaccgtttccctccagcagatcgaggggccgcgcggctttcaatatctcaaggatgacatacaggaacgtgttgaccttcgctcgcaagggcgggtatcgaaggtcatgttcaggacatttgtcatcgaatga

SEQ ID NO: 7576 - DNA, 363 bp, Rhodoferax ferrireducens T118
atgtctttaatactcgctgttgacgactcgccgtccatgcgcaagatggtgtcgtttactttaaccggggctggctaccaggtggtggaagcggttgatggtgtagatgcctacgaaaaagcgcaggcgcaatcatttgatctggttctgacagatcagaatatgccccggcttgatggactcgggttgacccgtaagctcagggatcatccgcagttcaaaaccgttccaatcctggtgttgactacggagtcgagtgatttgatgaagcaggccgggcgggccgctggtgccaccggttggttggtcaagccgtttgacccggctcgattgcttgaggtcattaaaaaagtgatcaagtaa

SEQ ID NO: 7577 - DNA, 363 bp, Acidovorax avenae citrulli AAC00-1
atgcaatcgatcctcgccgttgatgattcgccctccatgcgcaagatggtgtccttcactttgacgggtgccggctaccacgtggtggaggccgtcgacggccaggatgccttggaaaaggcggaaacccatgacatccagctggtcctcgccgaccagaacatgccgcgcctggatggcatcggcctcacgcgcaagctgcgcgagcacccgcgcttcaagaccatccccatcctgatcctcaccaccgagtccagcgaccagatgaagcaggccggccgcaatgccggcgccacgggctggctggtgaaacccttcgaccccaaccgcctgatcgaggtcatccagaaagtgatccgctga

SEQ ID NO: 7578 - DNA, 363 bp, Acidovorax sp. JS42
atgcagtccattcttgcggtcgatgattctccgtccatgcggaaaatggtttccttcacgctcaccggagcggggtaccacgtggtggaagcggtggatggccaggacgcgctggaaaaggccgagacccacgacatccatctggtgctggccgaccagaacatgccgcgcctggacggcatcggcctcacgcgcaagctgcgcgagcatccgcgcttcaagagcattcccatcctcatcctcacgacggaatccagcgaccagatgaagcaggccggccgcagcgcgggcgccaccggctggctggtcaagccgttcgaccccacgcgcctcatcgaagtgatccaaaaggtcatccgctga

SEQ ID NO: 7579 - DNA, 363 bp, Verminephrobacter eiseniae EF01-2
atgccatcgattcttgccgtagatgattcaccttcgatgcggaaaatggtggcgttcaccctgaccggcgccggctatcacgtcgtggaggccgtggacgggcaagatgccctggaaaaggccgagacccaccgcatcgatctggtgctggcagaccagaacatgccacggctcgacggcctgggcctgacccgcaagctgcgcgagctgcccaaattcaagaccatcccgatcctgatcctgaccaccgaatcgagtgaccagatgaaacaggccggccgcacggcgggcgcgacgggctggctggtcaagcccttcgatccccatcgcctgatcgaggtgattcagaaagtgatccgttga

SEQ ID NO: 7580 - DNA, 363 bp, Methylibium petroleiphilum PM1
atgcattcaatcctggccgtggacgattccgcatcgatgcggcagatggtgtccttcaccctcaagagcgcaggctacgacgtcaccgaggccgtcgacggccaggacgcgtacgacaaggccgcgcagcgccagttcgacctggtgctcaccgaccagaacatgccccagctcgacggcatcggcctgaccaagaagctgcgcgagcacccgagcttcaaggccacgcctatcctgatcctgaccaccgagtccagcgaccagatgaagcaggccggccgggccgccggtgcgaccggatggatggtcaagcccttcgatccggccaagctgctcgaggtgatcaagaaggtcattcgctga

SEQ ID NO: 7581 - DNA, 363 bp, Delftia acidovorans SPH-1
atgcgatcgattctggctgttgatgattccccctcgatgcgaaagatggtggcgttcaccctcgcaggggcgggatttcgcgttgtggaggcggttgacggcgtggatgcgctcgagaaggcacagctcgaacaagtcgacctggtgctggccgaccagaacatgccgcgtctggatggcatcggcctgacccgcaagctgcgcgaagaccccaagttccagaacacgccgattctcattctcaccaccgaatccagcgaccagatgaagcaggccggacgcgccgcgggcgccacgggctggctggtcaagcccttcgatccaaaccgtttgatcgaagtcattcagaaagtaatgcgttga

SEQ ID NO: 7582 - DNA, 363 bp, Leptothrix cholodnii SP 6
atgcattcaatcctcgcagtagacgactcggcctcgatgcgccagatggtttccttcacgctcaagagcgccggctacaacgtggtcgaggcggtcgacggccaggacgcctgggagaaagcgggtagccgcagcttcgacctggtgctgaccgaccagaacatgcctcgcctggacggcatcggcctgacgaggaagctgcgcgagacctcccagttcaagaacacgccgatcctgatcctgaccaccgagtcgagcgaccagatgaagcaggcgggccgcagcgccggtgccaccggttggctggtcaagccgttcgacccgaccaagctgatcgaggtgatcaagaaagtggtgcgctga

SEQ ID NO: 7583 - DNA, 363 bp, Diaphorobacter TPSY uid29975; identical to SEQ ID NO: 7578

SEQ ID NO: 7584 - DNA, 540 bp, Burkholderia mallei ATCC 23344
atgtcctccgaagcaatgagcacgatgcagacgacgccggcctgcgacggcgagccgcccgcctggtacggcaagattccgggcgcgggcgacttcgtcaatcaccggctgtcgcacgagctcgcgggctggtgggagcgctggctccagcagggcatggccgcgatgcgccagcgcggcgacgacgagctcgcgcgttactacacggtcgcgccggtctggaacttcctgattccggcgggcgcgggcgcgcagtgcgtgcagccgggctgtctcgcgccgagttgcgatcgcgtcggccgctactacccggtgatcgcgacgctgccgatgcgcaccgccgattactggagcgcgctgccggacgccgccgacgcgttctattggcaggtcggcagcgcgctgctcgatgcgatccggcatgcgcgcgcgccggtgcagctcgagcaggcgctcgcgaaggtgcggctcgtgccgggcgcggccgcgggttcggcgtggttcggcgtggttcggcggcgcgggggacgggcccggtga

SEQ ID NO: 7585 - DNA, 906 bp, Burkholderia pseudomallei 1710b
atgcagacgacgccggcctgcgacggcgagccgcccgcctggtacggcaagattccgggcgcgggcgacttcgtcaatcaccggctgtcgcacgagctcgcgggctggtgggagcgctggctccagcagggcatggccgcgatgcgccagcgcggcgacgacgagctcgcgcgttactacacggtcgcgccggtctggaacttcctgattccggcgggcgcgggcgcgcagtgcgtgcagccgggctgtctcgcgccgagctgcgatcgcgtcggccgctactacccggtgatcgcgacgctgccgatgcgcaccgccgattactggagcgcgctgccggacgccgccgacgcgttctattggcaggtcggcagcgcgctgctcgatgcgatccggcatgcgcgcgcgccggtgcagctcgagcgggcgctcgcgaaggtgcggctcgtgccgggcgcggccgcgggttcggcgtggttcggcggcgcggggggcgggcccggtgagcgcgattggcgcggcggcgcgcgcgatgcggcccgcgaaagcgatgcgggctgggcgatcggcggagcgggcgatatcgacggagcgggcgtgcgcggtgcgggcgatgaaggcgacggaggcgatagaggcgatagaggcgaggcgggcggtatgagcggtgtgggcgcagcggacggcggcgacgcgcgcaacggcgcgctcgcgcagccgatgccgagcccgcccgcgacgcccgcttggccgggactttcgcagtatttcgatccgcacggcgcgacgagcttctggtggaccaatcgcgccgacggctcgccgctgcgcacgcacgcgcataccggcgcgccggacagccggctgttcctgcggctgttcggcggcgttcagcacggcgtgtag

SEQ ID NO: 7586 - DNA, 696 bp, Burkholderia 383
atgccctccgaagccatgagcccgacaccgccgttcacgcgtaccgacggcgatgcgccggcctggtacgggaagattcccggcgccggcgacttcgtgaacagccggttgccgcatgcgctcgcgctgtggtgggagcgctggctccagcagggaatggccgcgatgcgccagcgcggcgcggacgagatcgagcgccactacacggtcgcgccggtctggaatttcctgattccggcgggcgccggcgcgtcgtgcattcagcccggctgcctcgcgccgagctgcgatcgcgtggggcgctactacccggtgatcgtcacgctgccgatgcgcgcggccgattactggaacgggctgccggatgccgccgacgcgttctactggcaggtcggccaggcgctgctcgacgcgatccgccatgcacgcgcgccaggcgatctcgagcagatgctggagcgcgtgcggctcacacagggcgacgacacctacgccgacatcgtcgaaggcatgccggcgccgccgcctgaacggccggccccggctgcgtggccggggctgtccggttacttcgatccgcacggcggcaccagtttctggtggaccaaccgcgcggacgggtcgccgctgcgcacgcacgcgcatacgggcacgcccgacaacgcgctgttcctgacgctgttcggcggcagctag

SEQ ID NO: 7587 - DNA, 867 bp, Burkholderia thailandensis E264
atgccgacgacgcttgcctgcgacggcgagccgcccgcctggtacggaaagattccgggcgcgggcgatttcgtcaaccaccggctgtcgcacgagctcgccggctggtgggagcgctggcttcaacaagggatggccgcgatgcgccagcgcggcggcgacgagctcgcgcgctactacacggtcgcgccggtgtggaacttcctgattccggcgggcgcgggcgcgcagtgcgtgcagcccggctgcctcgcgccgagttgcgaccgcgtcggccgctactacccggtgatcgcgacgctgccgatgcgcaccgccgattactggagcgcgctgcccgacgtcgccgacgcgttctactggcaggtcggcagcgcgctgctcgatgcgatccggcatgcgcgcgcgccggtgcaactcgagcaggcgctcgcgaaggtgcggctcgtgcggggcgcggacgcacgatcggcggcgttcggcggcgcgggcggcgagcgtggcgagcttggcgaaagcggttggcgcggtgagcgcgttgcggcccgcgaaagcggcgaaggcggctgcatcggcggcgcgggcgacatcgacggcgccggcgaaagcggcaagagcggtgcaagcgacgagcgcggtgaaagcggcggcgaagcgcgaagcggcccgttcgctcggccgaggccgagcccgcccgcgacgcctgcctggccggggctttcgcagtatttcgatccgtacggcgcgacgagcttctggtggaccaatcgcgccgacggatcgccgctgcgcacgcacgcgcacaccggcgcgccggatagccgcctgttcctgcggctgttcggcggcgttcagcacggcgtgtag

SEQ ID NO: 7588 - DNA, 1437 bp, Jannaschia CCS1
atgaaggaccgggggggcacgcatattccgcattggcgcggctactacggcaaagtgccggtggccggcgatttcgtcagccatggcctgccccggtcggtggaaaacgtgctggacgactggctgcgccgtgccattcgcgacagtcagaagcggctggggcgcgactggctcgatgcgtttctggtgacgcccgtctggcgctttgcgctggcggcgggccttctggggccacagcccgtagcgggcgtgatgatgccgtcggtggaccgtgtgggccgctactttccgctgatgatcgccgcctcccgacccgatgccaccggcgatattctggcgctgtccgccgatgggctgttttatgacgccgccgaggcgctggttctgtcgcggttggacgccaccgtaccctttcaggccctggtcgatgggttgtccgccctgcccttcgcacatctgccccaaattgacccggaccccgaggacgaagccgccgccctgtggtggacgggccgtgacgcggcgcaaacccatgccaccatcggattacctcaacatactgatttttctgatatctttctatgcaaggcaccgaagagcctggccgggcacgccccggcaacacccgccccgctacggcaaccagaggcggcggagatgcaaccagaccaccggctgacacgacgccccatgctggtgcgcgaggcccccgcccccgacacgtcccccctcccccaatctccggcagagcccaccaccgccaccctgcttggcgttgatcacgccttcgcctcactcaaaggcacccgctctgccgcgctgacagatgccgtgtcggtgagtggcgatggtcaggcattctcgctcttgtccgggatcgggcaggatgccgccctgcccgcacaggtctcggggttggtgcctgtgctggccgagatcgccgcgccgttttcaatgaatgaccttatcgccgaggcgaagggcaaactggggcgcgccaataccttcctgaccgcccgcagcgcgacctcagggcagacgacggcagtggccaccataagtgttctggtgcaagcgcggcgatatgccgtgctttgggccgggcattgcaccgcctggctccagcgtgacggaacattgcacccgctcaaccggccccatgtggatgcccgcctgcgcggcaccgtcacccgcgctttgggtgtgacgcggactataacgtttgataccgccatcgggcaggctcaggctggggacagattcctgttgctgtctcccggtgtgacccacgccctcccccccgatgaaattgcccgcactttggccactgctgacacgccacaaatggctgtgacacaagtgacccagaatgcgctgatcgaaggcactcctcttgacgccaccgcgctcgccatcttcctatcaccgcgctcctga

SEQ ID NO: 7589 - DNA, 777 bp, Saccharophagus degradans 2-40
atggaagctgttggtgatttccaaacaaacagcacagctaatccagcaccgcagacagatacctgcgggctgtttggcaaactgccgcaacaaggtgattttatttcgcactttttacctgctgcatttacagatgtttggcatgcttggctgcaagggtgtttgggtgtaagtaaagaacagcttggcgacacctggttagatttttatttaaccagccctgtttggcgcttttcacttatgcccactattacacacccgcaaagcgtggcgggcataatgatcccaagtgtggatgaagtcggccgctacttcccgcttaccttagtacaaatatataaccacacaccttggtctgcttacttacatggcgatgcgtggtttagccaactggagagcgctgcacttttagctttagaagaacatactagctactctaattttatcggcaacttcgaaatgctaccttcgctacagttacctgagtttagcaattttgaaacactgcacgctcaacattcctacgcagaaaattttgtagtcgaaacaccacctagtaacagcgaccaacaactgcctttaaacctattacacaaagcctaccagcgaatttacggtgcctacggcatatggtggacacagggctcagagcatattgcacctacactgttggtaaacagtggcctacccgatgcaggccaatttgcagccatgctagatggcaactggcaacagtggggatggaacctggaatctgtattagaaaataaaaattaa

SEQ ID NO: 7590 - DNA, 492 bp, Rhodobacter sphaeroides 2 4 1
atggcttctgagcgcgccatggccgggttcttcggcaagctgccgtccaccggcgatttcgtgacgcgcggcctctcgcccgccttccgcgcggcctgggacggctggatcacgcgccatgtcgcgggccggctcggcgcgggtcccgagggcgggctgcgggtgcggctccgctccggcgggcgggtcgcggggggcgtggtgctgcccggccgcgaccggatcggccggagcttcccgctctcgctccttctggtggcggacgggctgcccggaccggacggcctcgatccgtggtgcgaggcggcccgggcggcggccgccgtccacccggagccggacgcgctctggcaggcgctgagcgatattcctgtcccggaaggcgacgccgcagcggccgcgccgctccttctctggacgggtaaggccagcgccgcctgcgatccccgcgacccggcggaggccctcgggaggctcctcggaaccggctga

SEQ ID NO: 7591 - DNA, 732 bp, Shewanella frigidimarina NCIMB 400
atgtcctgcgaacctttaacatcagtaggttactgtggcaaagtcccctcaaaaggggattttattcagcagaacttaaatgttgattttcttaaaaattggaatgactggttacaagctgttattgcggtgagtaaagaacaaaccgaacacaattggttggattattatctgacgagtcccatatggcatttttcgttatctgccggtgtgtgttgcgaccaagccgtcgtcgggaccgtcattccaagtgttgaccatgttggtcgccattatccattcacattagccggattacataatcaatcggctttaagaggttggaaagacaatcagtgggttgaggtttttgaacagaatatattacaagtgcttgaagatgatactgttcttagtaaatggttagatgccattacaaaagagactttaacggttgccgccaataacgacaagctactcgagagtgaatcgttagatcgcaacaagaaagcgtgggtatttcaaggcgacaattctcctgatgtacttttattactggaccagcaatacagaaaacgctttgatcgttacagcatttggtggacagagggctctgacgatgttgaaccgtgcacgattattacggaaggcttgccacagatcagtcaatttatttctatgttaaatggtcaatggcaacaacgtggttggaatactgcagagctcattaaggagcaaacatcatgcacttaa

SEQ ID NO: 7592 - DNA, 681 bp, Pseudomonas aeruginosa UCBPP-PA14
ttgaacagcgtcggtttctacggcaagctggccggccgcggcgatttcgtcagccgcggcctgccgaacaccttcgtcgaaccctgggacgcctggctggccagcggcatgcgcgccagccaggacgaactcggcgcggcctggctcgacgcctacctgaccagcccgctgtggcgcttcgccatcgcccccggcctgctcggcggcgaagcggtggccggggtggtgatgccgagcatcgaccgggtcggtcgctatttcccgctgaccgtcgcctgcctgctgccggcgaacgccgacctcggcgggctggtcggcggcgacgacggctggttcgagcaggtcgagagcctgctgctctccaccctcgaaccggaggccgaggtcgaggccttcgagcaggcggtggcgcagctcccggcccctccctgcggaccgcgcatcgaacaatcgctgatcagcggcaacctgctgcgcagcgaagcggtgaccccggcgcagcgcctcgccgcgctggcccagcatgcctgcgacggcgccagccactggtggggacgcggctcggcacggatctccgccggcctgatgcgctaccagggcctgccgccggcgccggcgttcggacgattcctcaccggagagggcgaggtgatcccgctctttcccggcatacccggttaa

SEQ ID NO: 7593 - DNA, 516 bp, Paracoccus denitrificans PD1222
atgcccggaagcgttctaggcccgcaggccggcttctggggcaagctgcccgcgcgcggggatttcgtcggccgcgggctgcccgaggcgttccgccgccgctgggaccgctgggccgcgacgcatctggccgggcgcgaaggctggcccggcgactggccccacgactggcccgatggcgggctgcggctgcgcatcgcctcgggcgggcgggcggcggcggggctggtgctgccctcggccgacgcggtggggcggcgctttccgctggcgctgttcctgctggacgacacgctgcccgggcccgaggcgctggagccctggtgcgaggccgcgctgcaagccgccgccgaacccgacccggatgcgctgtggcaggcgctggcggccctgcccacgcccataggcaaggccgatgcgccgccgctactgctgtggcggcgcggacatccggcgctggaggccgatccggcggcacccgaaccggccctggcggcgatcttcagttcaggttga

SEQ ID NO: 7594 - DNA, 714 bp, Acidovorax avenae citrulli AAC00-1
gtgtcctggcaatctctgatgccgtggtcccgcgcgcagccgcgcgtggcctggttcgggaagctgcccggccagggagacttcgtgggccggcgcatgccccgggccatgagcggcgcctgggacgaatggctgagccacggcctggggcacctgcggtccaccgcgcatggcgactgggagcgcacgttcacgcaggcgccgctgtggtccttcgtggccagcggcggcaagggcgccgctccgtcgtgcggcgtgctcgcccccagcatcgaccgcgtggggcgctgctatccgctcaccgtgatggcggtgggcgagggcggccggcagtcgctggccgccgatggcgtgctcgggcagttcttctcggaggcctgcgatgcggtcatcgaggcgcgcaggctggccctgccggcggacgcgctcgacacccgcctgtccaggctgccatggcccttcgccgccacggcgccggacggcagggggcagggcggcgacatggcgggcatcctctccgatctcggcatgggcgggaccgccgggcagggcgaggcgatgttctcccgtgggcgggacatcctgcgcgcgggacaggccgccagcttctggtggtcctacccgcccggggccggcggccgcagctgcgagcactggggcgttcccaatgaaagcctgttcctgcgtcttttcggcggaggcccgaatgcataa

SEQ ID NO: 7595 - DNA, 525 bp, Burkholderia mallei SAVP1
atgagcacgatgcagacgacgccggcctgcgacggcgagccgcccgcctggtacggcaagattccgggcgcgggcgacttcgtcaatcaccggctgtcgcacgagctcgcgggctggtgggagcgctggctccagcagggcatggccgcgatgcgccagcgcggcgacgacgagctcgcgcgttactacacggtcgcgccggtctggaacttcctgattccggcgggcgcgggcgcgcagtgcgtgcagccgggctgtctcgcgccgagttgcgatcgcgtcggccgctactacccggtgatcgcgacgctgccgatgcgcaccgccgattactggagcgcgctgccggacgccgccgacgcgttctattggcaggtcggcagcgcgctgctcgatgcgatccggcatgcgcgcgcgccggtgcagctcgagcaggcgctcgcgaaggtgcggctcgtgccgggcgcggccgcgggttcggcgtggttcggcgtggttcggcggcgcgggggacgggcccggtga

SEQ ID NO: 7596 - DNA, 492 bp, Rhodobacter sphaeroides ATCC 17029
atggcttctgagcgcgccatggccgggttcttcggcaagctgccgtccaccggcgatttcgtgacgcgcggcctctcgcccgccttccgcgccgcctgggacggctggatcacgcgccatgtcgcgggccggctcggcgcgggtcccgagggcgggctgcgggtgcggctccgctccggcgggcgggtgacggggggcgtggtgctgcccggccgcgaccggatcggccggagcttcccgctctcgctcctcctggtggcggacggactgcccggaccggaaggcctcgacccctggtgcgaggcggcccgggcggcggcggccgcccatccggagccggacgcgctctggcaggcgctgagcgacattcccgtcccggaaggcgacgccgcagcggccgcgccgctccttctctggacgggcaaggcctgcgtcgcctgcgatccccgcgacccggcggaggccctcgagaggctcctcggaaccggctga

SEQ ID NO: 7597 - DNA, 906 bp, Burkholderia mallei NCTC 10247
atgagcacgatgcagacgacgccggcctgcgacggcgagccgcccgcctggtacggcaagattccgggcgcgggcgacttcgtcaatcaccggctgtcgcacgagctcgcgggctggtgggagcgctggctccagcagggcatggccgcgatgcgccagcgcggcgacgacgagctcgcgcgttactacacggtcgcgccggtctggaacttcctgattccggcgggcgcgggcgcgcagtgcgtgcagccgggctgtctcgcgccgagttgcgatcgcgtcggccgctactacccggtgatcgcgacgctgccgatgcgcaccgccgattactggagcgcgctgccggacgccgccgacgcgttctattggcaggtcggcagcgcgctgctcgatgcgatccggcatgcgcgcgcgccggtgcagctcgagcaggcgctcgcgaaggtgcggctcgtgccgggcgcggccgcgggttcggcgtggttcggcggcgcgggggacgggcccggtgagcgcgattggcgcggcggcgcgcgcgatgcggcccgcgaaagcgatgcgggctgggcgatcggcggagcgggcgatatcgacggagcgggcgtgcgcggtgcgggcgatgaaggcgacggaggcgatagaggcgaggcgggcggcatgagcagtgtgggcgcagcggacggcggcgacgcgcgcaacggcgcgctcgcgcagccgatgccgagcccgcccgcgacgcccgcttggccgggactttcgcagtatttcgatccgcacggcgcgacgagcttctggtggaccaatcgcgccgacggctcgccgctgcgcacgcacgcgcataccggcgcgccggacagccggctgttcctgcggctgttcggcggcgttcagcacggcgtgtag

SEQ ID NO: 7598 - DNA, 987 bp, Burkholderia pseudomallei 668
atgcagacgacgccggcctgcgacggcgagccgcccgcctggtacggcaagattccgggcgcgggcgacttcgtcaatcaccggctgtcgcacgagctcgcgggctggtgggagcgctggctccagcagggcatggccgcgatgcgccagcgcggcgacgacgagctcgcgcgttactacacggtcgcgccggtctggaacttcctgattccggcgggcgcgggcgcgcagtgcgtgcagccgggctgtctcgcgccgagctgcgatcgcgttggccgctactacccggtgatcgcgacgctgccgatgcgcaccgccgattactggagcgcgctgccggacgccgccgacgcgttctattggcaggtcggcagcgcgctgctcgatgcgatccggcatgcgcgcgcgccggtgcagctcgagcgggcgctcgcgaaggtgcggctcgtgccgggcgcggccgcgggttcggcgtggttcggcggcgccgggggcggacccggtgagcgcgattggcgcggcggcgcgcgcgatgcggcccgtgaaagcgatgcgggctgggcgatcggcggagcgggcgatatcgacggagcgggcgtgcgcggtgcaggcgatgaaggcgatagaggcgatagaggcgacagaggcgatagaggcgacagaggcgatagaggcgacagaggcgacagaggcgacagaggcgacagaggcgacagaggcgatagaggcgaggtgggcggtatgagcggtgtgggcgcagcggacggcggcgacgcgcgcaacggcgcgctcgcgcagccgatgccgagcccgcccgcgacgcccgcttggccgggactttcgcagtatttcgatccgcacggcgcgacgagcttctggtggaccaatcgcgccgacggctcgccgctgcgcacgcacgcgcataccggcgcgccggacagccggctgttcctgcggctgttcggcggcgttcagcacggcgtgtag

SEQ ID NO: 7599 - DNA, 984 bp, Burkholderia pseudomallei 1106a
atgtcctccgaagcaatgagcacgatgcagacgacgccggcctgcgacggcgagccgcccgcctggtacggcaagattccgggcgcgggcgacttcgtcaatcaccggctgtcgcacgagctcgcgggctggtgggagcgctggctccagcagggcatggccgcgatgcgccagcgcggcgaagacgagctcgcgcgttactacacggtcgcgccggtctggaacttcctgattccggcgggcgcgggcgcgcagtgcgtgcagccgggctgtctcgcgccgagctgcgatcgcgtcggccgctactacccggtgatcgcgacgctgccgatgcgcaccgccgattactggagcgcgctgccggacgccgccgacgcgttctattggcaggtcggcagcgcgctgctcgatgcgatccggcatgcgcgcgcgccggtgcagctcgagcgggcgctcgcgaaggtgcggctcgtgccgggcgcggccgcgggttcggcgtggttcggcggcgcggggggcgggcccggtgagcgcgattggcgcggcggcgcgcgcgatgcggcccgcgaaagcgatgcgggctgggcgatcggcggagcgggcgatatcgacggagcgggcgtgcgcggtgcgggcgatgaaggcaacggaggcgacagaggcgacagaggcgacagaggcgacagaggcgacagaggcgatagaggcgatagaggcgatagaggcgaggcgggcggcatgagcagtgtgggcgcagcggacggcggcgacgcgcgcaacggcgcgctcgcgcagccgatgccgagcccgcccgcgacgcccgcttggccgggactttcgcagtatttcgatccgcacggcgcgacgagcttctggtggaccaatcgcgccgacggctcgccgctgcgcacgcacgcgcataccggcgcgccggacagccgcctgttcctgcggctgttcggcggcgttcagcacggcgtgtag

SEQ ID NO: 7600 - DNA, 690 bp, Pseudomonas mendocina ymp
atgacggtgggcttctacggcaagctggcgagccgcggcgacttcatccatcgcggcctgcccagcgccttcatcgaatcctgggacgcctggctggccacgggcatcgccaccagccagcaggagctgggtccggcctggctcgatgcctatctggtcagcccgctgtggcgcttcgccctggcgccgggcctggtaagtagcggagcggtcaccggggtgatgatgcccagcgtcgaccgggtcggtcgttatttcccgctgaccatcgcctgcctgctggacgccgatgccgacctgggctcgctgctcggcggcccggacgcctggtacgagcaggccgaggcgttgttgctgtcgacgctggaggaaggcagcgaatgcgaggccttcgaggccgcggtggccgcccttggcgatccgccctgcagccggcgcaggccgcgcacgccaggctttcggcagatgcatttcggtgtcgccagcccggccgagcgcctggccgtgctggctcagctcacctgtgaaggcgccagtctgtggtgggggcgcggctcggagcatgtcgccgccggcctgctgtgctgcgccgggatgccggcagcgcaggcgttcagtggcctgttgctgggagcggatgtatcgccggctcccagcctggccgcgcagttgcagagcgagagccgatga

SEQ ID NO: 7601 - DNA, 531 bp, Acidiphilium cryptum JF-5
gtggcgcgggtgagcggcttttacggcaagattccggcgcgcggcgacttcgtcggcgccggcctgccgcgggctgtggtcgacgcgttcgatggctggatgcgcgcgagcctcgaggccagccgcaacgcgctgggcgatgactggcaggcctgctggatggaagcgccggtctggcgatttgccgcgccggtcgcgggcgtgccgctcggtggcgtgtggctgcccagcatcgaccgtgtcgggcgcgcctttccgctggtgctcgcgaccgatgcggcctgcgccggctccgcctggctcgacgcggtcgaggagatcggcatcgccgccgtcaccgcggatgtgccgccggataccttcgccgcccgtctggcagatctcccgcccgatccgtgcgagccggcatatggctggtggtcggccggggggccgcatcgcggtcctggccgcatcgaggtcgccggcttgcccgaccccgccggtttcgcggcgttcctgcgcgatgaggccggggagacggtgcgatga

SEQ ID NO: 7602 - DNA, 681 bp, Pseudomonas aeruginosa PA7
ttgaacagcgtcggtttctacggcaagctggccggccgcggcgacttcgtcagccgcggcctgccgaacaccttcgtcgagccctgggacgcctggctggccagcggcatgcgcgccagccaggacgaactcggcgcggcctggctcgacgcctacctgaccagcccgctgtggcgcttcgccatcgcccccggcctgctcggcgacgatgcggtggccggagtggtgatgccgagcatcgaccgggtcggccgctacttcccgctcaccgtggcctgcctgctgccggcgaacgccgacctcggcgcgctggtcggcggcgacgacggctggttcgagcaggtcgagggcctgctgctctccaccctcgaaccggaagccgaggtcgaagccttcgagcaggcggtggcgcagctcccggcgccgccctgcggcccgcgcatcgagcagtcgctgatcagcggcaacctgctgcgcagcgaggcggcgaccccggcacagcgcctcgccgccctggcccagcacgcctgcgacggcgccagccactggtggggccgcggctcggcgcggatttccgcaggcctgatgcgctaccagggactgccgccggcgccggcgttcggacgatttctcaccggcgagggcgaggtgatcccgctctttcccggcatacccggttaa

SEQ ID NO: 7603 - DNA, 723 bp, Serratia proteamaculans 568
atgatgagcaatgacctgatcccaaccacaagcattggctggtatggcaagatcccttccgccggtgacttcctgcagcgtcgtctgccggatatggtggttaacaattgggcccactggttccataacggcctggtgaatctgcagcgcaatccaccgggcgcgaacggaaatcctttcagcaatgcgccagtatggaacttcgtcattccggccacgctcggcagtcagtatgtccagatgggctgcctgttgcccgctcgtgaccgggtgggacgtcattacccgatctgcgccctacgcctgttctgccagcaagactggcgaactcagcagttgaacatggcggcggaatggtacaaccagctcggccaccggctgctcaatggcgtgcgcaacggtttttccgccgagcagctcgaccgttcgctgctggaaatccccgcgctgccgaccccaccggcggaggccgattccgagatcctgtcgattatcggcttccagcatcctgacgtacccggcctgggctggcaacaggcggccgactgtttcgacccggcgcaatacaccagtttctggtggaccaatcaggccgatgggcatccgctctatacccatgtgcacagcggtaaccttaccgtgcaactgttctctctgctgtttgaacccaatggctgggcgcgccccggtcgtggcggtcaatatccgcagatgtttgattaa

SEQ ID NO: 7604 - DNA, 705 bp, Delftia acidovorans SPH-1
atgtccggaccggctgtgaacgccatgaccctccagcgaccctgcgccgcctggtggggcaagctgccaagccagggcgatttcgtcggccggcgcatgccccacgcactgaccatgcgctgggacgagtggctgcgcaacggcatggaccagctgcgcagcgatgcggccgacaactggtccacgcgcttcgtgcactcgcccctgtggttcttcctgtgccccgcctccatcctgggccagcccatggtgggcgtgatcgggcccagctccgaccgcatcggccggctctttccactggccatcatggccacggtggacggcagctccggcatgccggcgtccgaccaggacatcgaacgctttctgagcggcgcccgtgatgcgctcatcgacgcgcggcgcctgcccctgtcggcccagcagctcgacgagcggctggccaccctgcaatggccgttccagcaggacggccgcacgccgggcagcgcctccatccacagcctgctggcggaccttgacatgggcgcctcgcagggcaacgccgcgcgcctgccacgcatggactggcgcgcctgcatgcgcccgggctccaccacctccgtctggtggatctcggccacgccgcgccacgcccctgacgaagtggtccagcacgaagtgctgcaccgccgcctgttcacccggctgttcaagggcgcctga

SEQ ID NO: 7605 - DNA, 696 bp, Leptothrix cholodnii SP 6
atgcacgaagcccccggctggtacggaaaactcggcgcgctgggtgacttcgcctcgcgccgcctgccgcacgcgcaggtgcaggcgctcgaccactggctggccagcgtgatgtcgatcagccagtccgaactcggcggcgcctggctcgaccactacctgcgcgcgccgctgtggcgctacgcctgggcgcccggcgtggtcgacaaccagtggtggttcggcgtgctgatgcccagctgcgacagcgtcggccgctacttcccgctgctgctggcgcagccgcgcgcgcaggcgccgcaggaccggctggcgctcaaccacctcgaactctggtggcgccacctggccgaggccgcgctcgccacgctggccgaacgcgccacgctcgacgagttcgagcaggcgctggccgaagcaccgccctggcccacgccggccagcgccaacccgccgctggcccgcagcagccgcaaccgcatcaccggccgcccctgcgaggagcaaccgctcggcccgcgcaccgacctggccgactggctcggccaccgcgccgcgcaggcgctgctgcagcagctcggcggccacagcctgtggtggccgttcgagctgggccgcagcaccccgccgatccgcctgctgcagggcctgccggacggcgccgaattcggcgccctgctcggccacgccgattga

SEQ ID NO: 7606 - DNA, 639 bp, Xanthomonas oryzae PXO99A
atgcaacgcccgccgggtttctacggcaagctgcccgcggttggcgatttcgtacatcgccgcttgccggagacgtttgtcgacccgtggcatgtggcgatgcaaggcgtgttgtctgccaacgcggcaacgatcgcgacgcctgcgcagcacgcaccggtgtggcgcttcgtgctgatgcccggcctcgcggggacggctgcatgggtcggggcgatgcgggcgagcgtcgatcgggtcggccgcgcgttccccttggtcatcgccgcagcgctgcctgcacgcgatgccgatggcgcgacagctgccgccacgccgacccatttgcgtctgcccgcatggctggatgctgccaacacggtgttgtgcactatcggtgcaaagcgacagcaagatggtgcctggttggaccacgcctgcgtggcgctcgcccaacacgcgcacgacgacgcatccgtgctggcgccgccgcttgcggacgcgaccactgctggcagcagcctgtggtggacggcgatgacagcatctgcgccgggtgcctggatgcgtcttgccggctggcctgcggccggtcatgcgccgatcctgcttggaccctcgcatgcgccgagcgcctgtcttgcagaggcagtgcaatga

SEQ ID NO: 7607 - DNA, 702 bp, Methylocella silvestris BL2
atgatgcgctgcggcctcatcggcaagatcgccgcaaagcccgactatgtcgccctcgacgcgccggcgcccctgctggcggcgatggagccgtggctgcacgcgtccatcgcctccagccgtctgatgcttggcgagtcgtggcagggcgtcttccgcgccgcgccgatctggcggttctggcttggcgcagagatcgccggcgcgcctgtccttggcgccttggcgccctcgatcgacgccggcggccgctatttcccgctgatcgctttcgcctccagcgaggcggcaatagcgattttgccgcccgaatttgccgatcacgacgcctggttcaaagccgccgaagcgctgctgctcgcctcccttgggcaaggggcgagctatgaggcgacggtcgccgccgtcgagcgcctgcctgcgcccgcctgcgcgcccgccgtcgcgatccggccgccgctggctgcgctcgcgggcggcgtcaccgcgccgctcgacgacaagccgctggcggaggtgttttcctggcttcgtcgcgccgactggggcaaatcctatggcgcgcgcagtttctggtggacggctggcggcgtcagttttcgcccgcgcgcgcttggtttttatcatctgcccgacccgtcgctgtttgccgccatgctgacgggtgaattttctggcggctccggcgccgggatgggataa

SEQ ID NO: 7608 - DNA, 669 bp, Methylobacterium nodulans ORS 2060
atgcggctcggtctctacggcaagctgccgatgaagcgcgacttcgtcgcccacgacgtgccgcgcaccgtcctcgccgccgtcgagccctggctccagggcgggctcgcggcgagccgggcgcggctcgccgagggctggcgcgaggcatacctgcgcgcgccgctctggcggttctggctcggcgccgacatctgcggggcgcccgtgctcggggtgctgatgccctcggtcgacgggatcggccgctacttcccgctcgcgctcttcgccatcgcggaccgcggcgaggccctgcccccgccggaggtggacgcgcacgccccctggtgcgcggcggccgaagcgctgctgctctccgccctcgacgagagggcgaccttcgaggccctgaccgcccgactcgccaccctcccctttctcggggcggagccgccgccggaggacgcgccggacgcgctcgcgctgccgctcgcgctcggcttcccggcgatcctcgaccaggcgcggcgcgccgatcccgcgcgccacgccgcggcgctcgcagtgttctggacgcaagggggcgagggcttcgcgccgcgcgccgtcgtggcgcaccggatgccccggcccgacctgttcgcctccctcctcaccggcgagtttccgggaggcgcgccgtgctga

SEQ ID NO: 7609 - DNA, 1452 bp, Agrobacterium vitis S4
atggcattgcgacctgcccagacagaaaagcccgccaatcaggaccggatcgggtttttcggcaaattaccaagccatggcgacttcctctcggatggcctggaacgggagatggtcgcgacgctcgatggctggatccgtggcggcctgcacgcctgtgaacaggaattcggctcggcttggccggagctattcagcgcctcccctccttggcggttcatcgtcgaaaaaggcgtctggggccaagtggctcatgcgggtgtcatgctggccagccgtgatcgggttggtcgcagttttccgctgatcatcatggcgcagatgcaccgcttcacccatcacccccgcacgctgtttctggaccatacttggttcatggccgccgaaggcctggctgaatcgacgatgacgcgggaatttgacatcaaccgcttcactgaaaccctgaagcgcatgcgtatgccccgtccccaggaggaagagggcaccgccaccgccagcaaggatggcactgcgctctggtggtatatcgacccgcagacctcaaaaccgcagggccttcgcttttcaagccagatgaaggccgaggacttcctgcggcttttccggcaaagcgccggccttacatcccgaccacaagacacaaccgcccctgcctcatcccgtgccccagggccagtcccgataaaagccgaggcaagacctgcgcctcaacggaccgctccaagcccggataagccgcccagagaccaacaagcacctgagccgcaagcagcagggctacggtatagttatgccacccatgccggcacacgattttcgatcaatgcggatgggctattcatctgcgaaaaaccaaggattttcgccattgccgacggtgttggcgacgacaccgcgtcgcaggaagccgcacgctatactgcaggccaactggccgaaatcggtgagaccgccgatctggacaccatattgcaggaaatcaaaggcaagcttggcagggccaatagcctgttgcaggcccgcacgcaacgcacagacggaaccgcacccgccgccagcgttgttgttgccgccttggtgaatcatcaacttctgctggtttgggcgggggatgctagggcctatctgttgcgtgacggcacaatggtaccactgacccgcgaccatatcgccatcggcctgcaaaaacgactgcggcgcggggtaggattggatcagcaatttttgccggaaacgctgaccaccgacatattaccgggcgaccgcctgttgttatgcagttttccgctgatccaggtcctgacggagcgaaccgtcgcggaaattctgcaccaatgcaccgatacagaaagcgccgagcggttggttcaggaggctttgattgccaatgtgcgcgaaaatgtgagcgctatcgtcgttagcctggcacgtagcgatgcctctgcctga

SEQ ID NO: 7610 - DNA, 699 bp, Azotobacter vinelandii DJ
atgagcatggtggcccccatcttccaggctgaaaccgccgtgggctggtacggcaagatcccggcggccggcgacttcgtgatgcgccagttgccttatccgctgctgcgcgcctgggagcgctggatgcagagtggcctgaacgccctgcgccaacagggcgcgcagatgctgtcgcaacactacgccgtggcgccggcctggaatttcctgctgccggccggactgggctgcgacgccgtgcaactgggctgcctcgcgccgagccacgaccgggtcggtcgccactacccgctggcggcgatcctcggcgtaccgccggcggagttcgacaacgccctgctggaaggggcggcgccgttctaccgccaggtcggcgaggccattctcggcgccgtgcgccagggactttcggtcgagcaactgagcgaccggctggccgccgtgccgggcgactggcgggggcggccgccgcgtggcggtgccggcgacatcctcgccgtgctggagcccggagccggcgaccagggcctggcctggccggaactgtcgctgtccttcgacgcccgcggcgcgaccggtttctggtggacccaccagggcgacggcgcgcccctgcagacccacacccacaacggcgaaccggacgatgcgctgttcgcccgcctgttcggtcctcaacggggggacgtatcgtga

SEQ ID NO: 7611 - DNA, 726 bp, Variovorax paradoxus S110
atgaacagcggcattccttcgccgcgggtgtgggtgcccgacgacgagcagatcggctggtacggcaagctgcccgcggccggcgactttctctatcgccgcgtgccgcgcgagctccaggcctggtgggaccgctggatgcagaacggcctgggcaccttcaagcgctggcccgacgccatgacgcggcactacgtggtggcgccggtctggaacttcgcgattccggccacgcagggcgtggacgcggtgcagttcggctgcctggcgcccagctgcgaccgcgtggggcgctactaccccgtgtgcgtgacgctgcaggtggccgcctcgagctaccggccctccatgctcgagggctcggccgcgtggtactggcaatgcggcaccgcgctgctgcaggcgatccgccacagcgtggcgcccgaccagttcgaccgccaggtgctggccgcggcccacggcggcttccagaccgcgagcggcggctcggacgacatcctttcgatcctcgggcccgcggctggcggcgccggcgccacaggcgcgcagcagcgcctcggctggcccgagctgccgctgtgcttcgatgccttcggaagcaccagctactggtggaccaaccaggcggacggctcgccgctgcgcaccgccgcccacggcggaggcctcaacacgccgttgttctcgaagttgttttcacaggggcatgtgccatgggcatga

SEQ ID NO: 7612 - DNA, 627 bp, Variovorax paradoxus S110
gtgagcgacgacgcggctgttttttctgcattgcccggatggttcggcaagctgccgggcatgggcgacttcgcgcaccggcgcctgccggagtcgtttcgctcggtgtgggacccgtggctgcagcgcggattggcgcggctgcgcgaccggcatgcggactggacttcgcattacctcgaagcgccggtgtggtgctttgcgctcgggccgcaggtggttggcgaaggtgcatggatcggcgtgctgatgccgtcggtcgatggggtggggaggtactttccgttcacgctggcggtggggctcgatgcttctgcgggcggggcgctgcagggcgatgcactgcaggatgcgctgcggtggtgggcgcgggggacgcgggctgcgctcgaagggcttgaaggggatctggatgcgctgcggtttgatgcggtgctggagagggtgtttgctgctgccggtgatctcgaggtgcgcgagatggcagtggagtcgcttgccttgccgggggtgggggagtctttgtggcttggcgatccgggggctggtgacggggctcggatgcttgttgcggggttgcctttggatggtcggtttgaggctttgtttttggggggtggggaatga

SEQ ID NO: 7613 - DNA, 552 bp, Colwellia psychrerythraea 34H
atgtctacagtcactcaagaaaaaataacgcaagaaaaacttagcgatcaagaaagacaatacattttattaacccaaaatggtttgcctattattcaggagccttatcacgcgattgcagagcaaatgaaccttagtgttgagcaagtacttagcctgaccaaaagcatgcaggaacgtggcattatcagacgcattgccgctgtacctaatcactataaattaggttatcaatttaacggaatgaccgtatgggatattgatgatgagcaagctgaaaaatttggcgatgctgttggccgattaccttttgttagtcattgttatttaagaccacgctttttacctgactggaattacaacttattcgccatggtgcatggaaaaacagaagaatcaatagccaagtatcggggccagatcaaagaattgttaaaagaggtcttggtcacccgcaaccatgattcaagtcaagacattattaccaaaagtaatgatatgttaaccagcacagcaatactgaaaaaaacaggtttgcgattaaaaaagtaa

SEQ ID NO: 7614 - DNA, 501 bp, Ralstonia eutropha JMP134
atggaaccttacgcgcacgatgtcatcgaccttgcgctgatccgcgcgacgcagggcggccttccgcttgtcagctcgccctatgccgccgttggtacgcagcttggcatcgatgaagccgaggtcattgcccgcctgacggcaatgcaggcaaacggcacgctgcgccgcatcgcggcagtaccgaaccactatgcgctgggctggcgtgccaacggcatgactgtgtgggatgtggacgacgcctgcatcgacgcgctgggcgagcaggtcggtgcactgccattcgtgagccactgctaccggcgcccgcgcaacctgccgctgtggccgtacaacctcttcgccatggcgcatgcccgcacgcgggaagaggcgttaccgctcgtggcgcgcattgcgcagttgctcggtgacgcctgccgcgcgcacgacgtgttgtggtccacgcgcatcctcaagaagaccggcctgcgcctgccaccggcccgtaccgagtaa

SEQ ID NO: 7615 - DNA, 501 bp, Thiobacillus denitrificans ATCC 25259
atgaacgcccgcgacgacttccgcccgctcgacgacaccgaccgccgcatcatccaggcgacgcaggccgggctgccgctgacgccgcgcccctaccacgccgtcgccgaacagctcggcctgccggcggccgaggtgatgcagcgcatgcagcgcatgctcgacctcggcgtcatccgccgcatcggcgccgtgccgaaccactacgcgctgggctatcgcgccaacggcatgacggtgtgggacgtcgccgacgagcgcatcgacgaactcggcgagcggatcggccagctcgacttcgtcacccactgctaccggcgcccgcgccacctgccggactggccctacaacctgttcgccatggtgcacggcaggacgcgcgaggaagtggaggcgaaggccgcgctcatcgccgacgcgttgggtacggcgagccgcgcgcgcgacatcctgtacagtacgcgcatcctcaagaaaaccggcctgcgcatcggcgcatag

SEQ ID NO: 7616 - DNA, 516 bp, Pseudomonas aeruginosa UCBPP-PA14
atgtcggcctgcatttccccctctgacgccctgctcgcccgccgcctgatcgaactgacccaggccggcctgccgctggtcgccgacccttgggcgtggatcgccgcgcaactgcggctgagcgaggcggagaccctggcgctgctgaagcgcctgcgcgacgccggggtgatccggcgcatcgctgcggtgcccaaccactatcgccttggctaccggcacaacggcatgaccgtctgggacgtcgccgacgaacgcatcgaacgcctcggccggctggtcggcgggctgtccttcgtcagccattgctaccggcgcccgcgccatctgccgcagtggcgctacaacctgttcgccatggtccacggccgcagcgaagcggagatcgaaggctaccgccagcagatccgcctgctgctcggcgaggactgtcgcgccgacgagatgctggtgagcagccgcatcctgaagaagaccggcctgcgcctggcgcagaaggaggaacgtccatgctga

SEQ ID NO: 7617 - DNA, 483 bp, Paracoccus denitrificans PD1222
atgacggcgccggacgataccgaccgccggctgatcgccgcgacgcaagccgggttgccgctggtcgaggcgccctatgcccgcatcgccgccgatctgggcgtgtccgaaacgcaggtcatcgcccggctgtcggccctgaatgcgcagggcgtgatccgccgcatcgccatcgcgcccaatcattacgcgctgggaatgaccgcgaatggcatgagcgtctgggacgtggacgacgcgcaggcggaagccctgggcgaaaaggtcggcgcgctggatttcgtgacgcattgctatctgcgcccgcgcgcgccggtctggcgctacaacctgttcgccatgctgcacggccaaagccgggccgaggtcgaggaaaagcgcgcgcaggtccgcgccctgctcggccccgcctgccgggccgacgacatcctctattccacccggattctgaaaaagaccggcctgcgcctgaaggacggctaa

SEQ ID NO: 7618 - DNA, 483 bp, Acidovorax sp. JS42
atggcgcttgatgccttcgaccgtgcgctgatcgccgccacgcagggcgggctgccgctggtggcgcgcccctacgaagccgtgggcgccatgctgggcgtgcctggcgagcaggtacgcgagcgcctggcccggatgatcgacgagggcctggtgcgccgcatcggcgcggtgcccaaccattaccgcctgggctacacggccaacggcatgagcgtgtgggacgtggacgatacccaggtcgccgcgctgggccgccaagtcgccgcgctgccgggcgtgagccactgctaccgccgcccgcgccacctgccccactggccctacaacctgtttgccatgctgcatggccccagccgcgcgcatgtcgagcaacaggccgagcagattgccggcctgctgggcgatgcctgccgcgcccacgacatcctgtactccacggccatcctcaagaagaccggcctgcgcctcaaggaagactga

SEQ ID NO: 7619 - DNA, 522 bp, Marinobacter aquaeolei VT8
atgtccaccttcacttcgaagtctgactctgtgctgagtgcgcgagaccgcgaactcattgtcgccacccagtccggactgcccctggtttccgacccctgggccgaattgggcaaacaactggatatgcccgccgatgaagtgctgacacgttttcagaggatgcaggcgaccggtgttatccgccgggtagcggcggtacccgaccattaccgtctggggtttcgcttcaacggcatgaccgtttgggatgtcagcgacgatgcgattgccgaactgggcgagaaaatcggctgcctgccctttgtcagccactgctaccagcgcccccggcacttgccctactggagctacaacctgtttgccatggttcacggggtcagccgggacgaggtggagcacaaggcagcacagatccgcgaggtactcggcgatgcctgcaccggacacaccatcctttacagctccgccatcctgaaaaaaaccggattacgattgaaaaaacaaacagctaagcagtag

SEQ ID NO: 7620 - DNA, 495 bp, Methanoculleus marisnigri JR1
atggacagggtcgataaagaactactcatattgacacaggacggtatcgggtttgaggagaggccgtttctccgtgcggcgagaaggcttcggatcagcgaggaggaggtcgtcgcccggctgcagagactcaggcagatcggcgtcgtccgccggttcgggatgaggatcaacccccggaaagccgaactcatggcgaacgccatggtggtctggagcgtccccgagaactgcgtcgccgaggtcggagcggccatggcggagagccccgacgtgactcactgctacgagcgccgcaccatccccggacgctgggagtacaacctctacaccgtgctccactgccgtgaccgcgaggacgcgctccgcagggtcgcggccctctcccgggcgaccggtgccgccgactaccgggttctcttcagcaccgaggagttcaagcgggaaccgagcggccggatcgagcctgcggcagggccggggcgtgggcgatga

SEQ ID NO: 7621 - DNA, 516 bp, Pseudomonas aeruginosa PA7
atgtcggcctgcatttccccctctgacgccctgctcgcccgccgcctggtcgaactgacccaggccggcctgccgctggtcgccgacccctgggcgtggatcgccgcgcagctgcaactgagcgagacggagaccctggcgctgctgaggcgcctgcgcgacgccggggtgatccggcgcatcgccgcggtgcccaaccactatcgcctcggctaccggcacaacggcatgaccgtctgggacgtcgccgatgagcgcatcgaacgcctcggccggctggtcggcgggctgtccttcgtcagccactgctaccgccgcccgcgtcgtctgccgcaatggcgctacaacctgttcgccatggttcacggccgcagcgaagcgcagatcgaaggctaccgccagcagatccgcctgctcctcggcgaggactgtcgcgccgacgagatgctggtgagcagccgcatcctgaagaagaccggcctgcgcctggcgcagaaggaggaacgtccatgctga

SEQ ID NO: 7622 - DNA, 489 bp, Candidatus Methanoregula boonei 6A8
atgatggaccccatcgatatacagatccttgcagccctcgaagacgggctcccgctcgttcccgagccgtttgcagagatcgggaaacgtctcgggctttcggctgaggaagtgctcgcacgaacacaaaaacttcatgcggccggtgtgatccggcggttccgggcccggatcaaccagcgaaagctcggtatctctgcaaatgcccttgtggcctggcgctgtgacaaaaaacctgccgaaaagaccggcgctatccttgcctcctttccgtcggtcacccactgctatgagcgccggcccgtgccggggcggtgggagtactccctctataccgttcaccacgggcgctcccgtgaagctgtcgaagacgagatccggaaactggccggtgcagccggcctttcggattatcttgtcctctttagcaccgaggagttcaagcgtgtcccccatgtacggatcaacgggaacgggaggggatcatga

SEQ ID NO: 7623 - DNA, 486 bp, Dinoroseobacter shibae DFL 12
atgaaaatggatcatatcgaccgagcgctcatcgccgaaacccaggccgggttgcccctggtggccgagccctatgccgccgtggccgaggcgctcgggatgcccgaggaccaggtcatggcgcgcctgcgcagcctaaaggctcgcgggatcatgcgccggatcgccatcgcgcccaaccactacaagctgggcatgaccgcaaatggcatgaccgtctgggacgtgcgcgatgcggatgtggccgagctgggtgcccggatcggcgcgctcggctttgtctcccattgctacgagcggccccgcgcgctgccggactggccctacaacctcttcgcgatggtccatggcgacaccagagacgaggtcgaggccaagcgcgccgagatcgccaccctgctgggagcggcctgccgggcgtcggacgtcctctattccaagcgcatcctgaaaaagaccggcctgcggctggcaaaggggaaatga

SEQ ID NO: 7624 - DNA, 483 bp, Leptothrix cholodnii SP 6
atgccgcttgacgatttcgaccgcgacctgatcgccgccacgcaaggcggcctgccgctggtggcgcgcccctacgaagccgtgggcgcgatgctcggcgtgagcggcgagcaggtgcgtgagcgcctggcgcagatgctcgcgagcggtctgatccgccgcatcggcgcggtgcccaaccactacaagctcggcttcaccgccaacggcatgagcgtgtgggacgtcgacgacgcggtggtcgatcagctcggcgagcgcatcggcgcactcgccggcgtgagccactgctaccgccgcccgcgccatcggccggcctggccgtacaacctgttcgcgatgctgcacggccgctcgcgccacgaggtcgaacagcaggccgcgcagatcgccacgctgctcggcgcggcctgccgtggccacgacatcctctattccaccgcgatcctgaagaagaccggattgcgcctcaccgagacctga

SEQ ID NO: 7625 - DNA, 570 bp, Thauera sp. MZ1T
atggtgcaaggcatgtccgggaacggagccctcgcgcgggcggatgcgcaggatgccgcgggtgccggcatggatgaagctgcccttgcggagttcgaccgccgcctcgtgctcgccacccagggcggcctgccgctggttccacgcccctacgccgcgctggccgagacgctcggcgtggccgagggccgcgtgcgcgagcgcctcgccgccatgctcgccgacggccgcattcgccgcatcggcgcggtgcccaaccactacgccatcggctacaccgccaatggcatgagcgtgtgggacatcgacgccgcggtgatcgacgcggtcggcgagcgcgtcggtgcgctcgacttcgtcacccactgctaccgccgcccgcgccatctgcccgactggccctacaacctgttcgcgatggtgcacgccgccagccacgaggccgcgctcgcgcgcgtggaagagatcgccgcgctgatcgcggcggagtttcctggtgcctgccgcaaccgcgacgtgctgttctcgtctggcatcctgaaaaagacgggcctgcgcatcggcgcctga

SEQ ID NO: 7626 - DNA, 483 bp, Diaphorobacter TPSY uid29975
atggcgcttgatgccttcgaccgtgcgctcatcgccgccacgcagggcgggctgccgctggtggcgcgcccctacgaagccgtgggcgccatgctgggcgtgcccggcgagcaggtgcgcgagcgcctggcccggatgatcgacgagggcctggtgcgccgcatcggcgcggtgcccaaccattaccgcctgggctacacggccaacggcatgagcgtgtgggacgtggacgatacccaggtcgccgcgctgggtcgccaagtcgccgcgctgccgggcgtgagccactgctatcgccgcccgcgccacctgccccactggccctacaacctgtttgccatgctgcatggccccaaccgcgcgcatgtcgagcaacaggccgagcagattgccggcctgctgggcgatgcctgccgcgcccacgacatcctgtactccacggccatcctcaagaagaccggcctgcgcctcaaggaagactga

SEQ ID NO: 7627 - DNA, 489 bp, Candidatus Methanosphaerula palustris E1 9c
ttggatcagattgatgtttgcctgctccgggaacttgaacgtggtctcccgcttgttccggctccttttgaagagataggaaaaagattgaacctcagtggggccgaagtggtggaacggatcaggcttttgaaggaagcaggaatcataagaaaatttcgggcccgcattgaccagcggaaagtgggaatctccgcaaacgctcttgtggcgtggaaactgtcagggtcctgcgatgaggacaggggaaaactgctggcaacatttccttttgttacccattgctatgaacgcaggccggtaccgggacggtgggagtacacccattataccgtgcatcacgggtacagccgagacaaggtacacaatgagatcagaacaattgcagaacagatcggcagtccggattaccgtgtcctcttcagcacccgcgagtttaagcgcatgccgaacgtgaggatatgggaggacgggggaagtctcccatga

SEQ ID NO: 7628 - DNA, 435 bp, Jannaschia CCS1
atgcctgaggtggaaatcgagatcggcacccgcatattcagcgtggcctgccaggagggcgaggagccgttcctgcgctctgccgcgaagatgctggacacagaagcggccgtcgtgctgggacagatcgggcggatgccgcccgagcggatgctgttgatggcgggcctgatgctggccgacaagacggcggcgctggaggatgacctgcgggaattgcaggacaagatcgcgacccaggaccgcgcgctgcacaccgccgaggagcggttggccgaccggggccgcaagattgcagaattgcaggatgcaggcccggcgggcggcgtgcctgtgccggaggacctgagcgaaggccttgccgcgctggccgccaaggccgaggcgatggccgagatgctggacccaccctccgggagcgcctctggcgggtag

SEQ ID NO: 7629 - DNA, 546 bp, Ruegeria sp. TM1040
atgccggaagtgaccattcatatcgggggccgcgattttgaggtgtcctgtcaggaaggcgaagagagctttctgcatatggcggcggggatgctcgacgacgaggcgcaggtgctgtcggatcaaatcgggcggatgcccgaggcgcggatgctcttgatggcgggtttgatgcttgcggataagaccgcagccgtcgaggaccgcatcaaggaagtcgaggccaaactggccgagaaagacgcgctgctcgaagagcgggatgcagagctcgaggagttgcgcaacgcgccaccaccgcctgctgaacaaattgaggtgcccgtggtgccgccgcaggtcgccgagaccctcgcagagcttgcggcacgggccgaagcgctggcgggcgagatcgaagaaaaagccgcgccagatgatgacgaagacgacgatgaggctgcaaccactcccgcggtggatccgagcgccgacgcaatggcggcagaaggcaatgcggatgaggcccgtgaagagactcctgacgacgtcaaggaacaggtctga

SEQ ID NO: 7630 - DNA, 375 bp, Rhodobacter sphaeroides 2 4 1
atgcctgaactgtccatcaccatcggcggaaagagcttcgaagtggcctgtcagccgggcgaagaggagttcctgcacagcgccgccgcgatgctcgatgccgaggccatgcccgtggtcgagcagatggggcggatgaccgactcgcggatgctcctgatggcggggctgatgctggccgaccggatggccggcgccgacgaggagttgcggcggctccgcgcgcagctggccgagctcgaggcacgccccgcgcccgagccggagcggatcgaggtgccggtgatccctgcgggggtgaaggaggcgctggccgaacttgccgcacgggccgaggcgatggccgagcgggtcgaggagcgggcgcgggcctga

SEQ ID NO: 7631 - DNA, 363 bp, Paracoccus denitrificans PD1222
atggccgaagtggatttctcgatcgggcacaaggcctataccctagcctgccaggagggcgaggagcggttgctgaagcgcgccgccggcctgctggatgccgaggcccaggtgattctggaacaggcgggccggatgcctgagccgcggctcctgctgctgtcggggctgatgctggccgaccgcacctcggggctggaggaccgcgtcgccacgcttgagcgcgagttggcgcggctgaaatccaatccgcagcgcgtcgaggtcccggtggtgcccgagagcctgagcgaggccatggcggagctggcggcgcgggccgaggccctggcccagaaggccgaggaccagtcggcggactga

SEQ ID NO: 7632 - DNA, 375 bp, Rhodobacter sphaeroides ATCC 17029
atgcctgaactgtccatcaccatcggcggaaagagcttcgaagtggcctgtcagccgggcgaagaggagttcctgcacagcgccgccgcgatgctcgatgccgaggccatgcccgtggtcgagcagatggggcggatgaccgactcgcggatgctcctgatggcggggctgatgctggccgaccggatggccggcgccgacgaggagctgcggcggctccgcgcgcagctggccgagctcgaggcacgccccgcgcccgagccggagcggatcgaggtgccggtgatccctgcgggggtgaaagaggcgctggccgaactcgctgcacgggccgaggccatggccgagcgggtcgaggaacgggcgcgggcctga

SEQ ID NO: 7633 - DNA, 375 bp, Rhodobacter sphaeroides ATCC 17025
atgcctgaactgagcattgccatcggtggcaagaccttcgaggtcgcctgccagccgggcgaggaagagttcctgcacgcggccgcagccatgctcgacgccgaggcggcgcccgtggtcgagcagatgggccgcatgacggattcacggatgctgctgatggcgggactgatgctggccgaccggatggcgggcgtggacgaggagatccgccggctgcgcgagcaggtggccgaactcgaagcccgtccggcgccggagcccgagcggatcgaggtccccgtgatccccgagggcgtgaaagaggcgctggccgagcttgcggcgcgggccgaggccatggccgaacgggtcgaggagcgcgcccgcgcctga

SEQ ID NO: 7634 - DNA, 405 bp, Dinoroseobacter shibae DFL 12
atgcccgagctgacgatcaccatcggaccccgcgatttcaccgtcgcctgccaggcgggcgaagaaagctatctcgaagccgccgcagcgatgctcgatgccgagacgcgcgtgctctccgagcaggccggccggatgcccgaagcgcggatgctgctgatggccgggctgatgctggctgacaagaccgcggcggtcgaggacaagctgcgcgaggccgaggcgaagctggccgaactcgggcaggaactcgaggcgctgcgtaacgcgcccgcgcctgcgcccgaacggatcgaggtgccgatgatcccgcccagcgtggccgagggcatggccgagctggccgcacgcgcggaatccgtggccgacgcggtcgaggccaaggcccgtgcgggggctgcctga

SEQ ID NO: 7635 - DNA, 1089 bp, Thermobifida fusca YX
ttgctgcatggcgcgcctccgcgtctgtccacaggcgcgcagtccactgctcgccgtcccgaaacgatcccccacgctggagccatgtctgtactgctccgcgtgctcgtgcccactgttctgctgcctctagcggtcgcagccgtcccggctcgccatgccgcggccgacaccggcccgtggacgtggccgctgtccggcacccccgtagtgctgcgagccttcgacccgcccgcgcagcgctggcttgctggccaccgcggggtcgacctcgccgcggagccgggggatcccgtgctcgccgcgggagcgggccgggtgggtttcgccggaaccgtgggcggggtcccggtagtgaccgtcgtccacggcacgctgcgcaccacgtatcttccggtggcgccactcgtccgcaaaggtgaggaagtccacgccgggcagccgatcggacacctggccgagcatccccgccactgcgctccgcggccctgcctgcactgggggctgctgctcggccgcgactacatggacccgctctccctgctcggggaagcggctgtgcggctgctccccctcaccggcgacctatcacgcccgcggatgggcctgctggtagacgctggccagccgcccgatagagacgtgcgtgtagatctgggtgctcgccagcgacgcatggccgaggatctcctgcacgctgcgcaggtcagcacccccgttgagcagatgggtggcggcgctgtgccgcagcccgtgcggaccggtgcgcgccaccgccgcggtggcggcgtagacgtcgcggcgggcggtgcgctcccccagcctgccgccgcgggcccccagaaaaagggcgcgaccgctgtgcgcggtcgcccactgggggcggccgtcccgcagccaccggtcgacagcgtcgagcgcgggaaccccgatgggcaccactcgttcccggccgcctttgccgagcacccgcagggtgtgccgttcccagtccacgtcgtcaaggtccagcccgcacagttccgcaacccggatcgcagtgctgtagaggacttccaccacggcgctgcggcgcagcacgagcggtga

SEQ ID NO: 7636 - DNA, 876 bp, Frankia CcI3
gtgaccccgccggccgctggcccgctgggcggcggagaaggggacgagcacccggacccgccacccggcgacgtcggaccggagaactccgcggcaccgccggcccacggcggcggggtccgggctctgcgatggccgttgtcgggggccgtcacggtgagccgcggtttcaaacgcccgccttcgccctacggacccggtcatcgcggagtcgacctcaaggcctctccggccgccccggttctcgccgcggccgacggggtggtgagtttcgccgggtccgtggcgaaccgcggcatcgtcaccgtcacgcatggcgacctccgcacgacctacgaaccactgacgccggcgatcagccccggaaccgcggtccgagccggagacctgctcggctggatgagcgatggccatccaggctgtccggtggccgcatgcctgcactgggggcttctgcgcgggatagactacctcgatcccctgctgttcttccgcagaactccgccccgcctcctgcccctcctcccagcagatcgctcccctgggtcccccggccttgtctcaggctcgggggtgagcctgctcgaaggccgcgcgcaaccgttccggtgtcacatgggtgtagatctgcgtggtcgcgagactcgcatggccgagaaattcctggacggagcgcagatcggccccgccttccagcatgtgcgtcgccgccgaatgccgcagaccatgcggagtcaggccggccggagcgacaccggccgccaccctcgtcgtcagaatccgccgtaccgtgcgcggatcgaggcgacctccgcgcaggccgaggagcagcgcacgcccgctacgagcggtcatcagccgcggccgtcccgttga

SEQ ID NO: 7637 - DNA, 636 bp, Nocardioides JS614
atggccagccgacccaccgcccgccacgtcgtcccgaccctcctactgggtctggtgctggtcctgctcgccgcgccgcccgcctcggcgggcgagaccgacccggtcggcgtgtggccgttgctgcccgcaccctcggtcgtcgccgggctcgacccgcccgatgacccgtggggcgccgggcaccgtggcgtcgacctgctcggctcgccgggtcaaccggtccgcgccgcactgccgggccgggtcacctgggccgggccgctggccgggcgcggtgtggtggtcgtggaccacggcgcgacccgcacgacctacgagcccgtcgacgcctcggtcggcgtgggcgcgacgatcgcggcaggcgatcggatcggccggctctcggccgtcgggtcgcactgcccgccacgggcgtgcctgcactggggatggatccgcggtgacacctacctcgacccactgcggctcgtcggcgccggaccggtgcgactgttgccgctctggcgcgacgagccggtcggccgcggcgccgtcgcgtcgccgtggcgtccgccgtcgctggtgtacgccggctgggtcgcgccgatggcgctatgggcccgtcctcaggctctggggtgtgcctgctggtag

SEQ ID NO: 7638 - DNA, 489 bp, Mycobacterium vanbaalenii PYR-1
atgcggatcctggcgagcgcgatcgccgtcgcggtggtggcggccgcgccggccgcagccgacgacgtccggctgggctggccgctgaaaccctctccgacggtggtgcgccagttcgacgcgcccgccccgaactggcagcgtggccaccgtggtgtcgaccttgccggggccgacgggcagccggtgtatgcggcggcagccggcacagtggtgttcgccggcgatctggcaggaaggcccctggtgtcgatcgcgcacccgggtggcctgcgcaccacctatgaacccgtgcggcctgcggtacggcggggacagcaggtcaccgccgggaccgcgctgggcgaactggccacgggacatccgaactgcgcggcgccggcctgcctgcactggggagcgatgtgggggccggcgtcgcgggccgactacgtcgacccgctgggacttctcggcaccaccgcgatccggctgaagcctctgcgatga

SEQ ID NO: 7639 - DNA, 489 bp, Mycobacterium gilvum PYR-GCK
atgcgggttcttgtcctcgtggcgacactggtcgcgatctgcaccgcccccgcagaggccgatgacggtcgattggagtggccgatgcgacctcgtccggccgtggtgcgcgcgttcgacgcgccggcgccgaactggcagcgcggtcaccggggcgtcgatctgggcggggccgaggggcaggtgatccaggccgcggcgtcgggcacggtggtgttcgccggtgagctggccggacggcccctgatctcggtggcgcatccaggcgggctgcgcaccacctacgagccggtgtctccggtggtgcggcggggccaggtcgtctccacggggaccgcgctcgggcacctggtggcgggccatccgggatgcgcggccgcagcgtgcctgcactggggcgcgatgtggggtccgtcgtcgcgggccgactacgtcgacccgacgggactggtggtcaccgtgaccgtccgactcaaacccctgcgctga

SEQ ID NO: 7640 - DNA, 810 bp, Frankia EAN1pec
gtgccccacccgccgcgtttcgacccgcactggctcgtgatccccgctctcgcgctgatgatcgccctgggctgccccgggcgggtaccgatccgcgggtcgttcggcgcgggcgcaccggacgtgctgaccgctccggcaaccccggcaccgcccgtgacggccgcgatccctgccgcaccgacgagcccggacgccacgacctcaaggtcaccggcagacacacccgcgacgacggtggcgatcccccgaacggcctcctccgagcccaccgcagctccggcggtcaccgactccccaggcgggctcacggccgcggcgccgactgaacccacgcccggcgccccaacctcgtccccggcgcaggcccccgcgcaggcccccgtgccggacggcgaccagaggtggcattggccgctgccggaaccggtcacggtggccgggatcttccgcgctcccgcgcatccctacggcccgggccaccgtggggtggatcttcgttccgatcccggtgtcggtgtccgggcagcgcggccgggtgtcgtcgggttcgccggatgggtcggcgacaggtgggtcgtgacggtggtccacggcgcgctgcggaccacctacgagccggtacgccccctcgtccacgaaggccagccggttggcggtggcgatcagctcgggcttctcgaggccggccacccgggctgcccgggtgccgcctgcctgcactggggcgtgctgcgcggctccgagtacctcgatcccctctccttcttccaccgggtcccgccacggctgctgccgctggatggctga

SEQ ID NO: 7641 - DNA, 576 bp, Beutenbergia cavernae DSM 12333
atgccgaccacgaacgctgcccgcctcgccaccgccctgctcgcgctcggtgccctcgccgcagggatcggcgcacacgtgcgcgccgacgccgatccgccgcccgcgaccgacgcggcacggggccgatccgcgcccgtcccactcgagggcgcacctggctcgatctacgactggccgctcggtggaccgccgccggacgtcgtgcggcgcttcgagccgccgccggctccgtgggcggcggggcaccgcggagtcgatctcgccgccgcgcagggcacagccgtgctcgccgcatccgacggcgtcgtggcgttcgcggggaccgtcgccgatcgcggggtggtctccgtcgatcatgccgacggcatccggacgacgtacgagccgctcgcccccaccgtccccgccggtgagcgggtcgctcggggcgacgtcgtcgggatcctccagtccggccacgcggaggtgccgtgcctgcactggggcgcacggcgcggctcggacgactacctggatccgctcacgctcgtcggcgagccgccggtgatccggctgtacccgtcgtccggatag

SEQ ID NO: 7642 - DNA, 717 bp, Brachybacterium faecium DSM 4810
atgtccgctccctccgtcccgtgcccgtcggtgcgctcgctgccggccctgctcatgtgctgcatggcgctggcggcgctgctcgcgctgccggcgagcgcgcacgccggtgaggcgcgctggcagtggccggtgccggccccgcatcccgtgctgcgcgcgttcgaggagcccgagcacccgtacggcccgggccatcgcgggatcgacatcggcgtgacgggcgagggggcgcaggtccgggcggtggaggcgggcacggtgcggttcagcgggacggtggccggccggggcgtggtctcggtgacgcacgcggacgggctgctctccacctatgagccggtcagcgggaccgtggaggtgggcaccgcagtgctggccggcgaggtgctgggcacgctcgagcagcgctccgagctcgcgcactgcgcggaggagacatgtctgcatctgggcgcccgccggggaaaggactatctggatccgcagctgctgctggggctgcgggggccgagcgtcctgctgccctgggacggaccgggtgagagggcgccccgcacgggagcggcccgtccggggccgtctgcccccggggaggcggtgcgggccccggcaccgggagcggctgcgggatctgctgcgccggaggcgtccgcgctcccccggtcgcacccgatgcgacccggccgcggagccctgatcgctctcgtcgggtga

SEQ ID NO: 7643 - DNA, 816 bp, Kytococcus sedentarius DSM 20547
gtgggccacggtcgggtcatggcacccctcgagcaccccctcctgacccgttcccgggccctccgccgcctcggcgccgcgatgacggccgcgatcctcctggtcaccgggacccctgaccccgtcccggcgagcgacccgaccccggcgaccgagccacgcgtgagcgggaccgacccccacgtggacgccggggccagcacacagctccctcccccggcctggctgccctggcaacaccgcgtccagctcgacgtcgtcacccggcacgcggcccacacgtggggcctcgcagccgccgtgggtcaggcccccggctccccggcggcgccggggacggccgacggcgcggccccccgcgggtcgatgccgagcagctccaccgcagccctcaacccgctggactacaagtggccgatgtggccggtgaagctccgccgtgccttcaacccgcccaagaaggcatggggccggggacaccgcggggtggacctcgagggcgtgcccggccaaccggtgttcgccgccgggccgggattcatctcctggagcgggacgatcaactcggtgggttccctgtccgtgacgcacacgccgcggctgcgcaccacctacctgccgctgaccgggcgcttgccgatgggcacaccggtgatcgccggcacccccgtcgggctgctggccccggggcactgcctcccggcctgcttgcactggggggcgaaggtgtccgcgcggaagtacgtcgaccccaccctcctccccgacttcgcaccggagctcaagccccgggacgaacgccgccggcggcgctga

SEQ ID NO: 7644 - DNA, 513 bp, Nakamurella multipartita DSM 44233
atgggtggactgcggttgttcgcgctggtcgtgctgctggccggggtcggcccggccccgccggccgtcccggtccccgctgccgtgcccgctgccaccgggttcgtgctgccgatccccgggccgccgctggtgctcaccgcgttcgcgccgccccccacccggtacggcgccggccatcgcggggtcgacctgggtgccgccgccggcgtggtggtcgccgcggccggggccgggcgggtggtgttcgccggcgagctggccggccgcggggtgatctcggtcgagcacgagggcggtctgcgcaccacctacgagccggtgacggcctcggtcgccgccggatcgccggtcgccgcggggcagccgatcggcaccctgcaggccggtcaccccggctgcgccccggcgagttgcctgcactggggcgcccggctgccggacgggacctacctggacccgctggccctgctgcggccctgggcggtgcggttgtggccgtgggacggctga

SEQ ID NO: 7645 - DNA, 375 bp, Streptococcus agalactiae 2603
atgtctgatattggtattattgttgtttctcactctaaaaatattgctcaaggagttgttgatcttatttcagaggtagcaaaggatgtctcaataacttacgtgggtggaacagaagatggtgagattggtacttcttttgatcaagttcaacagattgtagagcaaaatgataaaaagacgttattagctttctttgatttaggttcagcaaaaatgaatttagagttagtagctgatttttcagaaaaaaatattatcattaactctgtcccagtagtggagggagcttacaccgctgctgctcttctacaggcaggtgctgacctggatagtattcaatcacaattagctgaattaactatcaataaataa

SEQ ID NO: 7646 - DNA, 375 bp, Listeria monocytogenes 4b F2365
atggctaaaccttatggcgttgttatcatttctcattccaaagatgtggcaaaaggcgtccatgatattattaaagaaattgccccagacgtctctatcacgcatgccggtggaacagaagacggtcgcattggcacaagttttgatgccgtaaatgaagcgattgaaagtaacgaagctaataaagtctacactttctacgacctcggaagcgccaaaatgaatatagaaacagtagaagaaatcagcgaaaaagaaattattctctttaatgcaccaattttagaaggtgcttacgctactgctgctcaagttcaaatggatgaaaaaccagaagtcatcgcagcaaatcttaaaacaattgaaattaaataa

SEQ ID NO: 7647 - DNA, 363 bp, Staphylococcus aureus COL
atgcctaaaattatacttgttagccacagtaaagaaattgcaagtggtacaaaatctttgttaaagcaaatggcaggtgacgttgatattataccaatcgggggattaccagatggttcaattggaacttcatttgatatcatccaagaagttttgactaaattagaggatgatgcattgtgtttttacgatattggatcttcagaaatgaatgtagatatggcaattgaaatgtatgatggtaatcatcgtgtgttaaaagttgatgcaccaattgttgaaggcagttttatcgcagcagtaaagctatcaatcggcggttcaattgatgatgcattagcagaaatcaaacaatcattttag

SEQ ID NO: 7648 - DNA, 375 bp, Staphylococcus epidermidis RP62A
atgacatctatagtagtagtaagtcatagtcataaaatcgcagaaggtgttaaacaattaatcaatcaaatgactgacggtggtgttgaccttattgccgttggtggcttaagtgacgatgaaatcggtacatcatttgatcaaatcgtctctgtaattaatggacttgaaaatgatgcgctttgtttctatgacattggttcagcaggcatgaatttagacacagctttagaaatgtacgaaggtgaccacaaaattgttaaaatggaagcgccaatcgttgaaggaagctttattgcaagtgtaggaattaaatcaaatatgagtatggatagtgttatctctgaagtaagagctaaatatcctgaagaataa

SEQ ID NO: 7649 - DNA, 390 bp, Mycoplasma capricolum ATCC 27343
atggtaggaatagtagttatttcacatagtagtaaaatagctcaaggtgctgttgaacttgctaaacaaatggcaaataatgtcaaaattattccagcaggtggaactaaagataacaatattggtactgatattgatttagttttaaaagcgatttatcaagcttttgatcaaaatgacggagctattattttatttgatttaggttcagctttaatgaatgctcaaatggcagttgaattattagaaccagaaattcaacaaaaagtagaaataattgatgctgctttagttgaaggaacaattctagcagctataaatagttctatgaataaaagtataaaagaaattaaacaagaattaattaatttaaaattaaataaaatctaa

SEQ ID NO: 7650 - DNA, 396 bp, Rubrobacter xylanophilus DSM 9941
gtggtggggctcgtgctggtctcccacagcgagaaggtggcccgcggcaccgccgagatggtggtgcagatggcgggggaggtggaggccatccccgtgggcggcgacccggagggcggcctggggacgaaccccgaccggataagggaggccctggagagtgcccgctccgacgagctgctggtcttcatggacgtggggagcgctgtcctcgcggtggagtcggtcgtcgagggtttggcggaggagctgcggtcgcgcgtgaggctcgtggacgccccgttcgtcgagggggccttcgccgccggggtgctcgcctcgaccggcgccggggccggggagtgcgtggaggccgcgctggaggcccgcaccgagcccaagctgcacggcgggtga

SEQ ID NO: 7651 - DNA, 363 bp, Staphylococcus aureus JH9; identical to SEQ ID NO: 7647

SEQ ID NO: 7652 - DNA, 363 bp, Staphylococcus aureus JH1; identical to SEQ ID NO: 7647

SEQ ID NO: 7653 - DNA, 393 bp, Thermoanaerobacter sp. X514
atggttggaatagtgttagtctctcactcaagaaaaatagtagaggggatttatgaacttgcaagccaaatgacaggtggaaaagttcctatagggatagctggcgggacacaagatggcagattgggaacagatgctacagagataatggaggaaattaaaaaagtagacgagggagaaggagtagtagttttagttgatattggaggtgctgtaatgagtgcgcaaatggcgatagaactcctgggagaggaatatgaaggtaaagtaaaaattgctgatgcacctttagtggagggagcaattgcagctagtgtagaggcttctataggtagtgattttgataaagttcttttagtggcagaagaagcaaaaaaacttaataaattttaa

SEQ ID NO: 7654 - DNA, 381 bp, Halorubrum lacusprofundi ATCC 49239
atggtcgggctcgtcgtcgtctcccacagcgagcgggcggccgaggggatcgtcgaagtcgccgccgagatggccggcaccacccgcatcgagcccgtcggcggcgacggacggggcgggatcggcaccgtcccggacgcgatcgaagacgcgatcgacgccgccgacgacggcgagggggtcgtcgtcctcgtcgatctgggtagcgccgtgatgaacgccgacgtggccgtcgagatgagcgacgcggaggccgtcatcgccgacgcacccgtgctggaaggcgcggtcaacgcggccgtcgccgccaccgacccgtccgccacgctcgactcggtccgcgagcaggccgaggcggcccgtgggatgaagaagctctga

SEQ ID NO: 7655 - DNA, 384 bp, Acidimicrobium ferrooxidans DSM 10331
gtgctggtggtgtcgcactcgcggcgattggcgcagggggcgtgcgagctcgtcggcgccatggccaagggggttcggctcgagtggcgaggaggtgagccccccgagcttggcgtgagtgtcgagctggtggcagatgcgctcgagggcctgctcgaagggggcggtgaggtggtcgtggtcgccgacctcgggtcctcggtcctggcggcagaagcggcggtcgagctgatcggggcaggcccacgcgtccgcgtcctgcgcggcgtcccgatgctcgagggcttcatcgcagccgcgatggcgctcacggtgggcggaggcctcgccgaggccgtcgccgcggccgaggcggcctgtggtgcgctcgagggcgggcgatga

SEQ ID NO: 7656 - DNA, 741 bp, Actinosynnema mirum DSM 43827
gtggtggtctcgcacagccgcaagctcgccgagggggtggtggagctggccgggcagatggcgccggaggtgcggctcgtcgccgtcggcggggacggcggcggtgggctggggacggactacgcggcggtggtcgaggggctggccgacgctgacggcgggggcggggtcgtggtgctgttcgacctcgggagcgcgcgcatggtcgcggacctggcggtggaggagttcggcggtgcggcggcggtcgtggacgcgccgctggtgaccggggccgtcgcggcggcggtggcggcccagggcggtgcggcgctggaggcggtggtggcggcggcgctctgggcctgggggagcggggagcgggcgggcggtggtgccgccggtgacggcgctgacggtggtgctgacggtggtgccggtgccggtgccggtgccggtgccggtcccggtggcgcaggcggtgccgccggtgacggcgtggtgcgggcggtggtgccgctggtcaacgacgtcgggttgcacgcgcggcccgccgggctggtcgcgcgggcgctggccggggtggacgcgcgcgtggtcgtccggcacggcgggcgggaggtcgacgcgcgcagcgtgctggagctgatgggactcggcgcgaccggcggggacagcgtggaggtcgtcgcggtcggggtcgacgccgaggaggcggtgcggcgggtgaccgagctggccgcgcgcgggttcgacgggtga

SEQ ID NO: 7657 - DNA, 396 bp, Geobacillus WCH70
atgaagcatgtcagccttgtattaatttcgcacagcgaggaaattgtaagcggtttaaagaaattattaaatcaagtccaacccgatgtcaacatcgcagttgccggtggaaacgatggggagatcgggacgaacgctttccgcatcaaagaagcgattgaatccgtctattcggaaaaaggggttgtcattctgtttgaccttggcagcgctttgatgaacgcggaattggcgatcgagatgctcgagaaaacagatcatatcgtgattgccgatgctccgttggtggaaggagcgtatatcgccgcggtggaagcgggattgggaaaatcgctcgatgaaatcgtccgggcgtgcgaacaggcgaaacagatggtgaaagtggcgcgttcatag

SEQ ID NO: 7658 - DNA, 399 bp, Rhizobium leguminosarum bv  trifolii WSM1325
atgaatggaaagaccgcaaatgtgggtatcgtgatcgtctcccactcgccgctggtggcaagggggatcgccgatatggtgcgacagatggtgggcgacagcgtgccgctcgcctggtcgggcggcaatgtccatggcgaactcggcaccgatgccggcggtatcctcagggcgatcgaggccgcttggtccgatgccggcgtcgccgtcttcgtcgatctcggcggtgctgaaacgaacagcgagatggcgatcgaaatgctgggccttccccgcgcagccctcgtctccatctgcaacgcgcctttggttgaaggcgccgtcatcgccgccgccgaggcgtcggggggcgcttcgctggccaaggtcgtcgccacagccgaggaactgtccccctga

SEQ ID NO: 7659 - DNA, 393 bp, Chloroflexus aggregans DSM 9485
atgatcggtcttttgatcgtctcgcatagcgcacgactggcagaaggtgtccaagagtttgtggcccaaatcagtggtggccagtttccggttatggcggcaggtggcgcaagtgatggttccttagggacaagtgtggagcggattttggctgctctcgatcaattgcgcaccaccgatgggattttggtgctggtcgatctgggtagtgcggtcatgagtgtcgagacggccctcgaacagtttaccggtccgccggtccaaattagtaatgcaccgttggtggaaggagcgtatctggcagcggtcgaggcatcaaatacggtgacgacactcgaacaggtagcagcagcagcgttgcaagcacgcgagctgattaaagtctacgagtaa

SEQ ID NO: 7660 - DNA, 387 bp, Anaerococcus prevotii DSM 20548
atgattaatatattaatagcaagccacagcaaggacttggccaagggcttaagtgatatcataggtcaaatgacaacagacgtaagaattgagtattctggtggtgatgacgagggaaatttaggatcgaattttgaagagattttcgctaagatgaacgagcttgccccagaaggtcttgtagttttcttcgacatgggatcatctatgatgaatgtcgaaacagcttattctatgcttgacgaagacttgaaagagaaagtcctaattgccggaagtcccctagtagaatcagctctagaaattagtctatctattaatgaagaaaccagtctagatgatataaaagagaaaatatcttcctataaatttaataaattggattga

SEQ ID NO: 7661 - DNA, 423 bp, Nakamurella multipartita DSM 44233
gtgacggtcggcatcgtgctggtctcgcacagcgcccagctggccgccgggctggccgaggtcgccgcgcagatggccccgaacgtggccatctgcccggccggcgggttggaggacggggcgatcggcacgtcgttcgacctgatcgcggccgcgatcgagcgggccgacacgggcgacggggcgatcctgctctacgacctgggcagcgggtacctcaccgccgagacggcggtggagttcctggaggacgagcagcgcgcgcgggtggtgatcgtggacgccccgttcgtgctggcggcggtgtccgcctcgatcgccgccaacgtcgggtcggacctgcgaggcgtggtcgacgcggccctgcaggcccggacggccaacggcccgggcggggtgcggtcggtcgacgagctggtctga

SEQ ID NO: 7662 - DNA, 435 bp, Ralstonia solanacearum
gtggtcgggccggattcctatctgacgctgcattaccggatcgctctggaaaacgatacggacatcgtcaccaccttcggcgataagcccgccacgctgctgttgggccagggccaactggcgccgacgctggaacaggcgctgctcggcatgcacgagggtgagcgcatgacgttccggctggcgcccgagcatgcattcgggccgcgcaatcccgatctgctgcagcgcgtatcgctggccacgctgcgcgagaactcctcgttcgaggaggactaccagcccggcgatctcgtcgagttcaacgcccccagcggcggcaagtacgcgggcgtgctgaaggaggtcggtgagaccgcggcgctgttcgatttcaatcatccgctggccgggcagaccatcctgttcgaagtccagctgatcggcatcctgtga

SEQ ID NO: 7663 - DNA, 378 bp, Acidovorax sp. JS42
gtgatcaataccttcgaggacaagcccgccacgctgtcggtcggcacgggcgagctttcgcccgcgctggagcagcgcctgatcgacctgcccgagggcgcgcgcgccacgttcgagctggccgcgggcgaggctttcggcgagcgcaaccccgacatgcagcaatgggtggccaagaagctgctgaacgagctgggcgacccccacgaggaatacaccgtgggcgacgtggtgcagttccccacgcccgacggcacgggccagtacgccggcgtggtgctggaggtgcgcgaagacggcgccgtgcgctttgacttcaaccacccgctggcgggcgtgcccgtcaccttcgaagtgctgctcatcggcgtgctctga

SEQ ID NO: 7664 - DNA, 498 bp, Polaromonas naphthalenivorans CJ2
atgcctaccctgcaatcctccatccagtccgcccagcccgatgccgtcccggtggtcgagccaggctccttcctgacgctgcactaccgcatggccgcgccgggcggcgccagcatcatcaacaccttcgacagcaagcccgccacgctgagcctgggcaacggcgagttgtcgccggccatcgagcagcgcctgctgggcctgcccgaaggcacgcgcaccacgttccagctggccgccggcgaggcttttggcgagcgcaacccggaactggtgcaatgggtggcgcgcaagctgctcaaccagctgggcgaccccgacgagcgctacagcgtgggcgatgtggtgcagttccccacgcccgacggcatgggccagtacgccggcgcggtgcaacagatcaaggacggcgacgacgcggcggtgcagttcgacttcaaccatccgctggccggccagccggtggagtttgaagtgcatgtgatcggggtgctgtga

SEQ ID NO: 7665 - DNA, 465 bp, Verminephrobacter eiseniae EF01-2
atgactgccatcgacatccccccgagcaccgtccagccgggctcctttctgacgctgcattaccgcctggcaggcccggcgggggatgtgatcaacacctttgccgacaagcctgccaccttgtcgctgggccaggggcaattggctcctgccgtggagcagcgcctgctgggcctggccgagggcacgcgcgccacgttcgagttggccgctggcgaggcctttggcgcgcgcaatggcgccatgcagcagtgggtgagcaggaaactgctcgatgaactgggcgcgcctggcgcgcattacggcgtgggcgacatggtgcagtttccgacgcccgacgggcagggccactacgccggcgccgtgctgcaggtgcgcgacgacggggcggtgcggttcgacttcaaccacccgctggcgggccagccggtgacgtttgaagtgcatctgatcggagtcctgtga

SEQ ID NO: 7666 - DNA, 462 bp, Methylibium petroleiphilum PM1
gtggtcaacgctcaacaggtccagcccgggtccttcctgaccctgcactaccggctcaccggcccggacggtgccgatctgatcaacaccttctccgacaagccggccacgctgtcgctgggcaccggcgagctggcgccggccgtggagcggcgcctgatcggcctggccgagggcgcgcacaccaccttccagctcgcccccggcgaggccttcggcgagcgcaacctcgaactgctgcagcgcgtggcgttgtcggtgctgcgcgcgcacggcgaccccgacgagcgctacggcgtcggcgacgtggtgcagttccccacgccggacgggcagggcgccttcgccggcgtgctacgccagctgggcccgcccgaagaagactgggcgctgttcgacttcaaccacccgctcgccggccagccgctgagcttcgaggtgcaactgatcggggtgctgtga

SEQ ID NO: 7667 - DNA, 447 bp, Polynucleobacter necessarius asymbioticus QLW P1DMWA 1
atgactaagcttactgttttgcctaattccttcttgaccctcaactatcggctcaccctgcctagcggggaggattacatcaatacttttatcgatcggcctgcgacggttttgatgggatctggacaatttgcaccttgttttgaaaaagtattgttgggtcttagtgttggcgagaaaaaaagcgagttactagaacccggagaaagttttggcgatcgcaaagaagatttggtgcaatgggtttctttgaaagctcttaaagaaggtcgcgatgacgatgcagaatttaatccaggggatgtgattgaatttaatgcgcctggtggcgcgcaatatgccggagtcttgcagtcgattgatgatgaaggcgcctggtttgatttcaatcatcccttggctggcagagcggtcacgttcgaagccgagattgttgccatcctctaa

SEQ ID NO: 7668 - DNA, 471 bp, Delftia acidovorans SPH-1
atgacctctagcgcttcttcctcggccctccccacggtccagaccggctcgttcctcacgctgcactaccgcctgtccgggcctgcaggcgatgtgatcaacaccttcaacgacaagcccgccacgctgtccctgggcgcgggcgagctgtcgcccgccgtcgagcagcgcctgctgggcctggccgaaggcacgcgcaccacgttcgagatgccggccggcgaagccttcggcgagcgcaacggcgacatgatgcagtgggtggcgcgcaagctgatgaacgagctgggcgacccgcacgagcagtacgcgcccggcgacgtggtgcagttccccacgcccgacggcctgggcagctacgcgggcgccgtggtgcaggtgcgcgaggacggcgccgtgctgttcgacttcaaccacccgctggcgggccagccggtgacgttcgaagtgcagatcatcggggtgctctga

SEQ ID NO: 7669 - DNA, 453 bp, Leptothrix cholodnii SP 6
gtgcctcaggtccaaccgggttcttttctgaccctgcattaccgtctgtccggccccgacggcgccgacatcgtcaacaccttcgccgacaagcccgcgacgctctcgctgggcaccggcgagctggcgcccgccatcgaggcgcagctgctgggcctcgaggaaggcacccgcagcaccttcacgctggccgccggcgaggccttcggcccgcgcagcccgcagatgatgcagcgcgtcaagctcgcgctgctgcgcgagttcggcgatccggacgagcaataccacgtcggcgacgtggtgcagttcccgacccccgacggccagggctcctacgccggcgtgctgcgcgagctcgggcccatcgaggaggactgggcgctgttcgacttcaaccacccgctggccggacagcccgtgaccttcgaggtgcagctgatcggggtgctgtga

SEQ ID NO: 7670 - DNA, 477 bp, Diaphorobacter TPSY uid29975
atgaccgcagacgccttcgcatcctcgtcctccgtgcccactgtgcaacagggctcgttcctcacgctgcactaccgcctggccggcccggcgggtgacgtgatcaataccttcgaggacaagcccgccacgctgtcggtcggcacgggcgagctctcgcccgcgctggagcagcgcctgatcgacctgcccgagggtgcgcgcgccacgttcgagctggccgcgggcgaggctttcggcgagcgcaaccccgacatgcagcaatgggtggccaagaagctgctgaacgagctgggcgacccccacgaggaatacaccgtgggcgacgtggtgcagttccccacgcccgacggcacgggccagtacgccggcgtggtgctggaggtgcgcgaagacggcgccgtgcgctttgacttcaaccacccgctggcgggcgtgcccgtcaccttcgaagtgctgctcatcggcgtgctctga

SEQ ID NO: 7671 - DNA, 444 bp, Variovorax paradoxus S110
atgtcccacgttgtgacttccggctcgttcctgaccctgcattaccggctggccggtccggcgggcgacatcatcaacaccttcgccgacaagcccgcgaccctgtcgctgggcaccggcgagctctcgccagccatggagcagcggctcatgggcctggaagagggcacccatgccaccttcgagctgcccgccggcgaggccttcggcgagcgcaatcccgagatgcagcaatgggtggccaggaagctgctcgcgcagatgggcgaccctgacgagcagtacgcggttggcgacgtggtgcagttccccacgcccgatggcgcgggcagctatgcgggcgcggtggtcgaatcgaacgagaccgcggtgcgcttcgacttcaaccatccgctggccgggcagcccgtgaccttcgaggtccggctgatcggtgtcctatga

SEQ ID NO: 7672 - DNA, 534 bp, Chlorobium luteolum DSM 273
atgtcgagaataaaggcaaaacgggtaggcttccggcttgacatgacccccatggtggatgtcgcattcctgctgttgacttttttcatgctcaccaccaagttccgtccgccggagcctgtggtgatagatcttccctcatcgcattccgagaagaagctccctgagtcggaagtcctcacggttacggtcagcggagacgatgactttttcatgggcgtttcctcccagtcgacacgtgaacgtcttttcaatgcagtcatccttcctaagctcgaggccacaggcatgtcgccggcagctgtcgcggattcgctgaaaagcttccgccttgctgaaacatttcctgtggaacgctctgagctcgaccggttcgtcgtgatggcgcgttttgccgaccagcggctccgccctgttgtcagggccgacggcggcgccgggttcgaggcggtcgaccatgtcatcaaggtgtacaagaaggcgaacctcctcaccttcaatctcgtcaccgttcttgaaaaggagagccgttag

SEQ ID NO: 7673 - DNA, 534 bp, Chlorobium chlorochromatii CaD3
atggcacgccacaaaagccaacgcaaaggcattcgccttgatatgacgccaatggtggatgtagcatttctactccttaccttttttatgctcgccgcccgctttcgtccgcctgaaacgctgagcgtaacaccgcccgcatcgcactccacgcaaagtttacccgatgccgatttgctcaccattaccgtcagccgcaaccatgcgctctacctaagcctctcctcaaaacgagatcgcgaagcgctttttaaccgcaccattcgccctcgcttgcaagcacgctccgtaagccacagcgccattgctgattcacttcgtcattttcggataagtgaacaaatgccgttgcaagctaatgaacttgggcaattgattgcccatgcaaaagcagccaatcccgaattgcaagcagtaattcgcgccgatggtgaagccgcacttgcgcccgttaatgaaattatgcaagctttccgtcgcgctggcattaccacctttcaccttgtaaccatgccaagcaaggaggctcgctaa

SEQ ID NO: 7674 - DNA, 606 bp, Cytophaga hutchinsonii ATCC 33406
atgtccaaagtaaaaacaaaaagacacagcatttctcttgacatgactgccatgtgtgatatggcattcctgttactgaccttcttcatccttaccgcgaagatgaaggtacctgagcccgctcagtttgatgtgccatcgtctgtatctactcagaaatacgaagagaaggatctgatccgtatctccatcagtaatgatgaccgtattttccttacgataccggatcagacattacgcagagaaatgattgatgcctatgcaaatacctttaaagtaaacttaacacctaagcaaaaagaagcttttgagttaacggaaacctttggtatgcaaaaagcagatttagtttcgtatctggcacaatctacagaaataagaaagaattttcctcaaacaggaattcctgcagattcaaccaacaatgaactggaacagtggatcgcaacagcaacaggagtaaggcctgagcttacaatcgcgatcaaaggcgataaagatgcaaactataacaagtttggagaagtaatcgctacccttaagaaaagaagaatttatgcgtttagtctggttacaacactggaagctaaaccggcaaacttataa

SEQ ID NO: 7675 - DNA, 534 bp, Chlorobium phaeobacteroides DSM 266
atgtcgaggataaaggcaaaacgggtaggatttcggatcgatatgacgccgatggtggatgttgcgttcctgttgctgacattttttatgcttaccaccaagtttcgacctcctgaaatagccgaggtcgatctcccgtcgtctcattctcagttaaagcttcccgaatcagatgttcttaccgtaacggtgagtggcgataacactttttttatgggagtatcttcccgtcaggcaaaggaaaagattttcaatactgcggtaaagccgaaacttcaggctgccaaaatttcggaagccgaaatcagggattcgctcaaaagttttcgacttgcggagagttttcctgttgggaaggatgagcttgacaagtttgttcttatggctcgttttgccaatccaaaacttcgccctgtaatcagggcggatgatgatgctggttttgatgcggtgaatcatgctataaaagtgtataaaaaagcaaatatgcttaccttcaatcttgttaccgtgcttgaaagggaggttcgctga

SEQ ID NO: 7676 - DNA, 627 bp, Flavobacterium johnsoniae UW101
atggctaaaataaaaatgaaaaagaagtcaacgtcgacagatatgactgcgatgtgtgatgttgcgttccttttgcttacgttctttatcttgaccgctactgctaaggtgcctgaggcacttcctgtagatatgccttcttctactgttcaaagtaaattaccagattctgatttggcaattattacaataggtcaaggaaaagacgggaaaagtaaagtgttttttgatatcaaaggaagagagattcgtaaaaaaactcttgaagggatgggagcaaaattcggtgtaactttttcagaacaggataaagaaaaatttgctttaatggatgacttcggtgtgccaattacaagtttaaagcaaatcatcgacatgaaagcggctgatagaactaaagcagaacaacctggaattccaatcgattctttagataatcaattaaaagagtggcttttagtttcaagaagagctacaatcgaccttgatgataaagaattgcagattgcaataaaaggagatgctaaagaacaatatccacaaatcaaaaagattatggatattttacaagatcaaaaaatcaattcctttaacctagttacaggaatgagaggaaaagatttttaa

SEQ ID NO: 7677 - DNA, 534 bp, Chlorobium limicola DSM 245
atgtcgagaatcaaggctaagagagtcggtttccggatcgatatgacgccgatggtggatgtggcatttcttctgctcacttttttcatgcttaccaccaagtttcgtccacctgaagtggttcagatcgatctgccctcttcccactcggagcttaagctccctgaatccgatgtgcttacggtaacggtaagcggagacaatacgtttttgatgggggtttcctcgcagcagtcacgggaaaagattttcaattcggtagtaaagcccaagctgcaggctgcgggtctttcgccggccgcggtcagtgattcacttggaagtttcaggcttaccgagagtttcagggtcggcagggaagaactcgataaatttgtcgtcatggcgcggtttgccgatcagaagctccgtccggtggttcgcgcggacgctgacgccgattatgaggcagtcgaccatgtcataaaggtctacaagaaagccaaccttctgaccttcaatcttgtaaccatgctggaaagggaggtacgctga

SEQ ID NO: 7678 - DNA, 534 bp, Chlorobium phaeobacteroides BS1
atgtcgaaagtcaaatccaaaagaataggtttcaggatcgatatgactcctatggtggacgtggcgtttcttctgttgactttttttatgctgaccaccaagtttcgtccgcctgaaccggttcagatagatctgccctcttctcatgctgagcagaaggtgccggagtcggatattctcaccgtgagcgtcagcggagacaatcgctattttatgggcgtatcgtcgcagctctcgcgaaccaggatattcgagcgggtggttcagccgaggcttgaagctgcgggcatgagcggcattgctgtcaccgactcgttgcaggggttcaagcttgccgaagtgtttcccgtacgtaaaaacgagttgcctcattttgtcacggcggccagatttgcaaatcaacgtctgcggccggttgtcaaggctgatgcgaacgcggattttgaggcggtcaaccatgtgctgaaactgttcaaggagtcaaatattctgacgtttaatctggtgactgttctcgagaaggaggttcgttga

SEQ ID NO: 7679 - DNA, 534 bp, Pelodictyon phaeoclathratiforme BU 1
atgtcgagaatcaaggctaaacggatcgggttcaggattgatatgactcccatggtggatgtcgcgtttcttctgttgacctttttcatgctcaccacgaagttccggcctcctgaggttgtcaagatcgatctcccctcatctcattcggagttgaaacttcccgaatcagatgttctgacggtgaccgttggtggtgacaatacctttttcatgggggtctcctcacagcagtcgagggtgaaaatattcaatgctgtcgtcaaaccgaagcttcaggcggcgggattatcttcggttgcagtagcggattcactgaaaaaattcaaacttgctgaaaatttccgggtagggcgcgatgaactcgacaaatttgttgttatggctcgctttgccgatcagaaacttcgtccggtaatccgtgctgatgccgatgcgggatttgatgccgtcaaccacgttatcaaggtctacaaaaaggcaaacctgcttaccttcaacctcattaccgttcttgaaagggaggcacgctga

SEQ ID NO: 7680 - DNA, 534 bp, Prosthecochloris aestuarii DSM 271
atgtcgaagattaaatccaaaaggattggtttcaggatcgatatgacgccgatggtcgatgtggcatttcttctgctgaccttttttatgctgaccacgaagtttcgtccacccgagccggtgaaagttgatattccttcttcccattcggaacagaaagtccccgaatcgggaattctcaccgtcacgatcagcggtgataacgcgtacttcatgggggtctcctcgcagcccgacagagtggctctttttgaacgtgttatcgggccaaaactcaaggcatcaggtgccgaccctgccgctgtcgaagattccctgcagcatttcaaacttgccgagagttttcctgtcgatcggggagaaattgagaggttcgtcatgacagccagggtctcaaaccagaaaatccgtccagtcgtcaaggcggatatgagtgctgattttgaggccgttgatcatgtgctgaaggtgtttaaggaatccaatattcttaccttcaatctggtaaccgctctcgagaaggagggaggctga

SEQ ID NO: 7681 - DNA, 618 bp, Pedobacter heparinus DSM 2366
atgccaagagcaaaggttcaaagaaagagtacttcgatagatatgaccgccatgtgcgacgtgtctttcctgttacttactttctttatattaacagcaactgcacgccagcctgaccctttggatgttaccattccttcatcaacctataagattaaggttcctgatacggatatggggatattatctatcggaaaaggtaaagtgttttatgagattctgggacaggatatcaggaaggctaccttacctaaaatgggtgagaagtataacatccagtttacacctgaagagatcaagcgcttttcagtagtggggtctttcggggttccgattcagaatttaaaagagtttcttaatatgaacggggaacagcggaaaaaatatcaggaaacgtcaggtgggatccctactgattctaccaacaatcaattggccgaatggttgatgcagtcccgtcattcagtagctgaacttcattctacacaaatgcgtgtaagtattaaaggtgatgcgaatgaggagtatcctaccgttaaaaaagtggttgatattcttcagaaacaaaaacttaacaaatttagtttaatcacatctgccgaaggcagcgcagaataa

SEQ ID NO: 7682 - DNA, 615 bp, Dyadobacter fermentans DSM 18053
atggcaaaggtaaggcctaagaaacatgcgccgcatactgatatgacggcgatgacggatgtggcgttcttgctcttgacgttcttcattatgacggcgacttttaagtcgaacgatgcagagattacaacacctacatcgatttcgcagatcaaagtgccagatgataagattatggtcatcagcattgacaaagcagggaaagtgttctttggtgtggatgcccagcccactcgcgctgcgatgctggacaacattggccaggccaagggcattacattcactgatgctgagaaggcgaagtttgcactgcagtcaagctttggtttacctctcaatcagctgaaaccctggttgaacatgccgaaagagcaaatgagccaggtgaagcaaccaggtatcccggttgactccacaggcgccagcgaattggcagactgggtttatgctgcgcggaaagcagacagccaactacgtattgcattgaaaggcgacaacctgtcgaagttccctgcattcaaagacgtactggcaaacctgcaatcgcagaatatcaacaagttcaacctgattacaggtagcgagcaagcaccagccggttacacaaacgattaa

SEQ ID NO: 7683 - DNA, 657 bp, Chitinophaga pinensis DSM 2588
atgcctaaagttaaaatgcccaggaagagcacgctggttgatatgaccgcgatgtgtgatgtggctttcttgctgctcactttcttcatgctggctaccaaatttaaaccggacgagccggtaactgtggtaactccgtcttccatcaatactaaactgctgccagattctgatgtaatcatgctgacagttgataaggacggtaaaatattcttcagcatggacggccagcctaaaaggcagcagctgatcaatgatctggaccaacagtataagctcggtctgaacgaaaaggaaaagaataactttatcattggctccagcatcggtacggatattaaaagcctgaagacttacctcgacatgaaacctgaagagcgtaagaaagctggtcttgaaaaaggtatcccttctgactctgccaataatgaagttgctgtatggatcgagtatgcaagatctgcacaaggtggaaaccctaagctgcagtattgtatcaaagccgacaatggtaccccttatcctgtaattaaggacatactggataccttcaaggagaaaaagattcagaagctgaacctggttacgaacctggaagctgctcctgcaggatctgcagcagctatagctcgtgccgaaggaaagtccgacgaataa

SEQ ID NO: 7684 - DNA, 432 bp, Ruegeria sp. TM1040
atgaccaaacatgtactttgcgccatcgacctgacgcatatggacgcggaagagaccttgctgaagcgcgcagcagagcttgcggaattctacggtgccacgctgagcgtggtgaccgtggtcccggactacggcatgagcattgtgggatcgtttttcaaggacggcaccatgaaagaggcagtcaaagaagcggaccgccaattgcatgcctatgtcaaaaaggtcgtgccggacatgaaggacgtgcagcacatcgttgaagtcggggcaaatgtctacgagatgatcctggatgcgatcaaacgctccgaagcagatctcgtcgtgatgggcgcgcataaacctgagttgatggatcgactacaaggtccaaactcagcacgcgtggcgcgctacgcaccatgttcggtgctgatcgtgcgagactga

SEQ ID NO: 7685 - DNA, 426 bp, Mesorhizobium BNC1
atgtacaaggacatactcctctccatcgatctcggccatgcggaagacgagctgcgtgcggtcaataccgctgtggaatacgcccgctcattcggcagccgtctgcacgtgatgaccgtcgtccccgattacgggatgtctattgttggcggcttctttcccaaggagcatgagcagaaggcgatcgagcacgcgaacgaggcgctgcacgaattcaccaaagaaaacgtgccctctgagatcaagcaccgtcacatcgtaggccacggctcgatttatcgcgagatcctgcgctatgcggggatcgtgaaggcggatctgatcgtattgtcggccaagaggccgggaccggaagactacctgatcggccccaatgcagcgcgggtcgttcgccacgccatgatttcagtactggttgtacggtag

SEQ ID NO: 7686 - DNA, 426 bp, Rhodobacter sphaeroides 2 4 1
atggccagaaccatcctgctgcccatcgatctgggcaatcccacggcccccgccgcggcgctgaacgaggcgctgaaactgctcgatcccgaagggacgctgcatgtcgtggcggttctgccggactatggctatgcacaggtctcgggcttcttccggcagggctacgagcaggaggcgctcaaggctctgggcaaggcgctgtcggcctgggtggccgataacgtgcccgagggggtggcggtccatccccatgtgctgcacggcacgatctatgacgagatcctgcgcgcggcgggcaagctcgaggtcgatctgatcgtgatcggcgcgcaccggcccgagttcagcgactatctcctcggcccgaatgccgcgcgcgtggtgcgtcacgcccgccaatccgtctatgtcgtaaggacctga

SEQ ID NO: 7687 - DNA, 426 bp, Rhodobacter sphaeroides ATCC 17029
atggccagaaccatcctgctgcccatcgatctgggtaatcccactgcccccgccgcggcgctgaacgaggcgctgaaactgctcgatcccgaagggacgctgcatgtcgtggcggttctgccggactatggctatgcacaggtctcgggcttcttccggcagggctacgagcaggaggcgctcaaggctctgggcaaggcgctgtcggcctgggtggccgataacgtgcccgagggggtggcggtccatccccatgtgctgcacggcacgatctatgacgagatcctgcgcgcggcgggcaagctcgaggtcgatctgatcgtgatcggcgcgcaccggcccgagttcagcgactatctcctcggcccgaatgccgcgcgcgtggtgcgtcacgcccgccaatccgtctatgtcgtaaggacctga

SEQ ID NO: 7688 - DNA, 426 bp, Rhodobacter sphaeroides ATCC 17025
atggcacggaccatcctgctgcccgtcgatctgggaaatccgcccgccaacaccgcggcgctggccgaggcgctgaagcttctggagccggggggacgcctgcatgtcgtctcggttctgcccgactatggctacgcgcaggtgtcgggcttcttccggcagggctacgagcaggaggcgctcaaggcgctcgggaaggcgctcgccgcctgggtcgccgaggcggtgcccgacgaggtggatgtccacccccacgtcctgcacggaaccgtctatgacgagatcctgcgcgcggccggcaagctcggcgccgacctcatcgtgatcggtgcccatcgccccgaactcagcgactatctcctcgggcccaatgccgcgcgcgtggtgcggcacgcccgccagtccgtctatgtcgtaaggaactga

SEQ ID NO: 7689 - DNA, 438 bp, Vibrio cholerae O395
atgtataaacatattcttgttccggttgatttgaatgaacaaggctttgccgacaaagcggtgcaacttgctgtctggcatgctaagcattccaatgccgaaattcacttgctgaacgtgttgcctggtattcacatgtccatggtggcgacttattttcctaaagacgcggccgcgcagatgaaaaatgatgtgcgagcacaactcaaagcctttgcggagaagcacatcgctgaagaggtggtgtacaaactccacatcgccgaaggcaaaccttacgccactatccttgattatgccgagcgcttaggggctgacttaattgttatgccaagccacaaacgctcacgcatcgataaagtgatgctcggctccgtggccagtaaagtggtagaaaattcgcctattaatgtcatggtcgtcaaaccacaaggttaa

SEQ ID NO: 7690 - DNA, 438 bp, Vibrio harveyi ATCC BAA-1116
atgtacaaacaaattcttgttccggttgatctaaatgaccaaggcttttctgaccgtgccgttgaattagcagtatggcaggcaaagcaagccaatgctgaagttcacttgcttactgtcttacctggtattcatatgtcgatggtcgcgacttacttcccgaaagacgcggcggcaaaaatgaagcaagatgtgaagcaacagctcaaagcctttgcagaccaacatatcgatgatgaagtcatttacaaagtccacgtggcagaaggcaaagcgtatgcaaccatccttgattacgctgaacgcttaggtgctgactttatcattatgccaagccacaaacgctcaaagatcaacaaagtgatgctgggctctgtagcaagcaaagtcgttgagaactcaccaatcaacgttatggtagtgaagcctcaaggctaa

SEQ ID NO: 7691 - DNA, 438 bp, Aliivibrio salmonicida LFI1238
atgtataaacaaattttggttccagtagatttaaacgataaaggctttgctgataaagcggttgaaatggcagtttggcacgcaaaacactctaatgctgaattacatttgcttaacgtattaccggggatccatatgtcgatggtatcgacctattttcctaaaggtgctgcgaaacaaatgaaagaagatgtatcaaaacagttaaatgaatttgcggctaaatttgtggatgatgatgtggtatacagagtgcatgttgccgaagggaaaccttatgtcactattttagattatgctgaacgtttaggtgccgatttgattgtgatgccaagccataaacgctctaaaattgataaagttatgctgggttctgtggcgagtaaagttgtcgaaaactcaccaattaacgtgatggttgtcaaacctcaaggttaa

SEQ ID NO: 7692 - DNA, 492 bp, Desulfomicrobium baculatum DSM 4028
atgtacaaacgtattcttgtccccattgacttgcaggagtctgatgaccgcgcccgttgcatgggcctggaaagagcaattgagctttgtcgcttatacaaagcacagttatacattctgacagttgttccggacatgggaatgccgattgtcgccaactatttcccaccagacgcaggagacaagattgtcagcgaggcggaggaaatgctgcacgacatggttggtgtctatatacctgatgatgtggaagccaattatcttgttgcgcagggctcgatctacagaagaattctacgcatggctgaaaaaataaatgcggacctcgtcgtcatgcccgcacatcgcctcaaactgcaggactatctcttgggcacgaacacggccaaggtcgtccgacatgccgcgtgttccgtgctggtggtgcgctacgactccgaggagtcctgcgccattttcgaccagtcgggcgacttcgaagacgaagagtga

SEQ ID NO: 7693 - DNA, 627 bp, Brucella suis 1330
atgaaaaccgcgcgcttcctgctgcttctgatcgcgaccacactgtgctttgccaccatggccgaggtgcatcggctgaatctctttgcaacggtcgaaggcggcaccgttcatggctatgggtttttcgtcggcggaggccgtcccagcgaagcacaacttatcatccgcaatgcccagggcgtcgagcttttcaagggacctgccggcgaggatggcagtttcagcttcacgcccgcagcacctgccgatctggttttgaccctcaacgcaggcgacggccatgtggccgaagcccatatcgccgccgaccggttctcccaatatggcgcacaaggcgcggccagttccaccaaggcagaaacgggcaccgccacccccaagggggctgccttgcccgcatcgccctcaccggaagaactgagcgccatgatcgaccaaagcgtggatcgcgccgtttcgcgtcagatcgcaccgctattggaggcttatgccgaggccgatggccgtgcccgcttttccgacatcgtgagcggcattgccgtcatcatcggtcttgcggggctttttctctgggccaaatcgcggggacgcgccagccattcagaccggcagcgtgagccatga

SEQ ID NO: 7694 - DNA, 648 bp, Desulfovibrio desulfuricans G20
atgaaattgcggactgaattgcggccgggctgcatatgcgttgtcatgttgctgatgcttacggcgctgccggcacaggcgcatcgggtgaacgtatttgcttatgccgagggcgaccggataactgtggaggccggatacagcaaatcgcggccggttatgggcggcacagtggtggtggccgacaaagccgacggggacgagtttctccgcggcgtgacggatgataatggcatatttgtctttaccgtgccggatgctgccaaaaaagagaaagccgatctgcgcatcaccctgcttgccggagaagggcatcaggactcatggatagtgcaggccggggaatacgctgcggagacagcgccgcgtgatgccgcagcttccggagtgacgtattccggccggggcgcggcgggcagccggcaggccggtgctgccgccggcgcgcagggcggccatgtgagcgttgatgaagcgctgctgcggcaggtggtggaagaagttgtggagcgcaagattgctcccgtgcgcaccatgctggtggagcagcatgaatcagggccggggtttgccgacattctgggcggtctgggatattttgcagggctgttcggcattgccgcgtatcttaaaagccgcaggcgctga

SEQ ID NO: 7695 - DNA, 639 bp, Rhodopseudomonas palustris BisB18
atgaggatggtcgtcttctcgctggcgttggctgcggcgctgctcggccctgcaaaccaggcgcttgcccataagatgaagctgttcgcgacggtggagggcgccatcgtatcaggctatgtctatttcagtcccggcggacgggcgcaggatgcccagatcaccgccaccgcgcccgatggggcgaccgtgttccaagggcgaaccgacccgcaaggtggattccacttcgaagcccagcgccgggtcgattaccgtatcgctgcggatggtggcgacggccacgaggcaggcttcaccatcaaggcggccgaattgccggagagcctgcccggcgacctgaccgcgggaaacgccaccgcaccgacgccaagcgccaccatgccgccagcggttgccgtcgcgacggcggcccccgttcctgatctggccgcgttggtcgagcagagcgtggcgcgacaaatccggccgctgcgcgaacaactcgacagctaccaggaagtcgtgcgttggcacgacgtgctgggcggcatcggctacatcattgggctgggcgggctggcctatggcttcgcgtcacggtcgggccacaagctgcgccgacgcctcgccgatggcgagaaggaagcggcacaatga

SEQ ID NO: 7696 - DNA, 633 bp, Rhodopseudomonas palustris BisB18
atgaacaagactattgcttcgttgctgcttgcgctggtcgtcgccggcggcgcctccggttcagccttcgcacacaaggtcgtcgccggtgccttcgccagtggggaccggatcgaaggtgaaatcggcttttccgacggttcgatggccaagaacgtggtggtcgaggtgctcgccgaagacggcagcaaactcggcgaggcccgcaccggtgaggacggcagcttcgtcttcgtgccgaccaagcgggtcgtccacatcttccacgccgatctcagcggcggccacgtcgccaacatccgcctggatgtctccgatctgcccgccagccttgctgcggtcgcggctgatggggacgcggcggtggccgtggctccggtgccgacgggcgcaacgccgtccgccgccgcgccgcccgccggcgctccggggccttctgcgatcagcgacgcgcagcgcgccgctttcgccgaggcggtgcgcaacgagatcaagccgctgcggcgcgagatcatcgcgctgaaggagaagaacgatctgcagtcgatcctcggcggcctcggctacatcgtgggcctgttcggcctgtggctgttcttggccgcgcgacgtcagaagccgctggccggttga

SEQ ID NO: 7697 - DNA, 528 bp, Rhodospirillum rubrum ATCC 11170
atgttcgccaccgtcgaaggcgccgagatcgtcggcagcgcctatttcggcggcggccgctatccccagggagtgacggtgcgtttcagcgcccccgatggccgcgagctgggaacggcggtgaccggcgccgatggcggcttccggttcctggcccgcgaaggcgtcgatcacgttattgtcgtcaattccggcgatggtcaccgcgccgagatgacggttcccgcccgcgatctgccccccggcctgcccggcggcgcgccgaattccgcccccgccgtcccggtcgcgatggcttccgtggtggcgactggcgaaggggggacgggcaatgatctcgccgccctcgcgggcagggatctcgccgccctggatgccctgctctcgcgcaagctgcgaccgatcgaggaccagcttgacgcccaggatgaccgcatcgccttccacgatatcctgggcggcatcggctatatcctgggccttgtcggtctggcgtcgctgctgctcgcccgccgcgccaaaaactaa

SEQ ID NO: 7698 - DNA, 594 bp, Rhodobacter sphaeroides 2 4 1
atgcgccgcgctctgctgctcctcctcgcgctcctgctcgccggtcccgccgcggcgcacagcctgcggctcttcgcgaaggtggaggggcgcgaggtcagcggctacggctttttcgtgggcggcggccggccccacggcgcgggctggagcgcccggatggcgggcctgccgctcgctcaaggtgaaaccgacgccgagggcggcttccgcttcgaggtgcccgaggcggtgacgggggatgtggtgatcgcgctcgacacgggcgaggggcacatggcccgcgtgacgctgccgcccgagcggttcggcggcgtgcccgtgccctcaggcgccatcccgctgaaggccggcggcccggcgctgcccgcggccgaggagcccccgtcggcgcttgcgccgaccgagaaagccccgtcgcccgaggtgctgcgggccatcgtctcgcaggcggtcgaggccgaggtcgccccgcttctcgagcggatcgagcagatggatgcgcggatgcgggtcactgacatcgtctcgggcctgttcctgatcttcggcggcgcgggcatcgccctctgggcacgcggccgcaggcgatga

SEQ ID NO: 7699 - DNA, 594 bp, Rhodobacter sphaeroides ATCC 17029
atgatccgcgctctcctgttcctgctcgcgctcctgctctccggtccggccgcggcgcacagcctgcggctcttcgcgaaggtggaggggcgcgaggtcagcggctacggcttcttcgtgggcggcggccggccccacggcgcggactggagcgcccgaatggcgggcctcccgcttgctcgaggtgaaaccgacgccgagggcggcttccgcttcgaggtgcccgaggcggtgacgggggatgtggtgatcgcgctcgacacgggcgaggggcacatggcccgagtgacgctgccgcccgagcggttcggcggtgcgcccgtgccctcaggcgccatcccgctgaaggccggcggcccggcgctgcctgtggccgaggagcgcccatcggcgcctgcgccgaccgaggacgccccgtcgcccgaggtgctgcgggccatcgtctcgcaggcggtcgaggccgaggtcgccccgcttctcgagcggatcgagcagatggacgcgcggatgcgggtcacggacatcgtctcgggcctgttcctgatcttcggcggcgcgggcatcgccctctgggcacgcggccgcaggcgatga

SEQ ID NO: 7700 - DNA, 573 bp, Rhodobacter sphaeroides ATCC 17025
atgaaactcctgctcgcgctggtcctcgttctggcgccgctgccggcgtttgcgcacaaggtgatcgcctcggtctatcctgcgggcgcggccatcgagggcgagatcggcttttccaacggcgacatggccgcgaaccagcgggtgacggtgaccgatcccgagggccggccgctcggcgaggtggtgaccgatgccgcgggcgccttcagcttcacgccggccgagccgattgcccacgtcttccacgccaatctcggcgcgggccatgtggccgaggtgacgatgccggccgaggcggtcgcggcgcttctggggaaggcttcccccgccaccccgcccggcgccggtgcgattccactgacaaccgccgcgctggcggggggagccgcgccgctctcgcgggacgaggtcgccgccatgctgcgcgacgagctgcgcccgctccggcaggagatcgcggcctacaaggagaagaacgaccttcagaccatcctgggcggccttggctggatcgccgggctcttcgggctcggcttctacctcgccgcccggcggcggatggcgggctga

SEQ ID NO: 7701 - DNA, 633 bp, Brucella ovis
atgaaaaccgcgcgcttcctgctgcttctgatcgcgaccacactgtgctttgccaccatggccgaggcgcatcggctgaatctctttgcaacggtcgaaggcggcaccgttcatggctatgggtttttcgtcggcggaggccgtcccagcgaagcacaacttatcatccgcaatgcccagggcgtcgagcttttcaagggacctgccggcgaggatggcagtttcagcttcacgcccgcagcacctgccgatctggttttgaccctcaacgcaggcgacggccatgtggccgaagcccatatcgccgccgaccggttctcccaatatggcgcacaaggcgcggccagttccaccaaggcagaaacgggcaccgccacccccaagggggctgccttgcccgcatcgccctcaccggaagaactgagcgccatgatcgaccaaagcgtggatcgcgccgttgccgtttcgcgtcagatcgcaccgctattggaggcttatgccgaggccgatggccgtgcccgcttttccgacatcgtgagcggcattgccgtcatcatcggtcttgcggggctttttctctgggccaaatcgcggggacgcgccagccattcagaccggcagcgtgagccatga

SEQ ID NO: 7702 - DNA, 561 bp, Shewanella sediminis HAW-EB3
atgtataaacatatttgcttaacttttatcctctcttgctgtctggttaatacggcgcaggcgcatcgtactaaggtctttgcctgggtggatggcacaaacgtcgtcggggaagtctacttcggtgggggggatcgggccaagggatcaaaggttgaattattggtgggcgaacagcttgtggagagcacaaatgcagacgaacagggcgaattcagattcgaaagacctcagcccggcgattatcaactcaaagctaatgccggacagggtcatgtcgcgactttcgtcattagcgcggatgagtttctaggtttaagtgggtctgcggccggaactattgagacgcaagaggtggagctggaagatgaggcagggtataagaatcgtgaaacttgtactgcgttagatgaagccgcattagttaaagtcattcagccgcttcgtaatcagttggatcaatatgaagctaatattcgctggcacgatattttgggcggtattggctatatcttaggggtgtttgggctctggtcgctgatgagagccagacgcggatga

SEQ ID NO: 7703 - DNA, 699 bp, Candidatus Desulfococcus oleovorans Hxd3
atgaaaagcgtgatcggttttacggttggaaggcatgccgttttcggcatcgtggccggcctggtcctttgcctgctggggatggggccggaccgggcccacgcccatcgtgtgatggtatttgcctggatcgacggcaacaccgtcctgacccagagcaagttcccgggtgacaggccggtttccgtcggcgacattatcgtgtcggacgccgacgggaagcagttattgaaggggacaacagatgaacagggtctgttttccttcggcctggagcagattcccgctccgggtccggttacgatttcacttgtcgcgggaatgggacatcaggcatcatggaccctgacagaaccagaagtagcacgggccatgggcgccgaaaagccggagccggatgattccctaccggtgaaggagaaagccgacgccgaatctgccggcaccgtttcgccggcggccgcggcaaccggtaccccggaatcggtggtgtcttcttcttcctgcctgaccgaagcccaggtggaggggattgttgaaaggtctcttgagcggaagctgtcaccggcaatgaacatgctggtgaccattcaggagtccatggccgtgggcgtggacgacgtggtggccggcatcgggtatatcctcggcctggcgggcattgccgcctatgcctacagccggggcagaaaaggataa

SEQ ID NO: 7704 - DNA, 801 bp, Desulfovibrio desulfuricans ATCC 27774
atgccttattgcaacagcatctcatacccccatgccccggcaagagacagcgcccgccccctctgttttttcttgcacatgcgcggctacacgtcaccgatccccgtctctctgcttgcctgccttctggctgccgccctgtattttctttcctgcactcccgctcaggcccacagggtcaatatttttgcctggactgaaggccgacaggtgatggtacaatgcggcttcagcggcggaaacaacgtaaagaacggccagataacggtgtatgacgccgccaatggcacaatattgcttgaagggcgcaccgacaccaatggtatgtttcattttgacataccaccacaaggcagaaaaaacggcttgcgtatacgtatcaatgcaggtgaagggcatcagaacgaatggcagcttgatgcggaagagctggaccaggctcctgaaccttcaggcgcaagtcccgcgcagacaggaaataccggcagtgtacccgcagcgcaacctacggataggcccgttaccgcgcgggggtccaccgcacaggttgagcctgcagccgttacctcgggcaacggggtttccatcgcaatagaagaaatacgcgccagtgtggacgccgcccttgaggcgcaggatgcccgcttcaacgccctgctggagtcccgcctggccccgctgcgccgccaactggcggagatgcggcaagacgacccgggattacgggaaatagtgggcggcatgggctggcttgtgggcctggccggaattgccctgtatttgcgctcgcggcatcgttaa

SEQ ID NO: 7705 - DNA, 609 bp, Desulfomicrobium baculatum DSM 4028
gtgcgtagctttttcctgctccttgttttcactttcctgatcccggccccggccctggcgcaccgggtcaatgtctttgcctacgtggaaggcggcgaggtcgtcgtcgaatgcagctacagcaaatcaaaacgggtcaggcacggcgccatcgcggttcaggacgccggcagcggggaaacgctgttgcagggaacgaccgatgaggcagggctgttccgcttctctatcccggaccaggcccgcacgtccggatccggcttgcgtattctcttgcaggccggagaagggcaccagaatgaatggatcgtggacgcggcggaattcatggacgcgggagctccgaggccccttgcgccgcatgcggaagttacggctgcaggcgcaatgagcccgggcagaactgatccgggcgcggcggggctgtcgcgagcggacgtggaagacgtggtcaatgccgccctcgacgcgaagcttgcccccatacgacgcgccctgcttgagcaaagccaaagcgggccgggattgcaggaaatcatcggcgggatcggatggattttcggattggtaggcatcggggcctacttcaagagccgcccgcgtgtttga

SEQ ID NO: 7706 - DNA, 618 bp, Desulfohalobium retbaense DSM 5692
atgagaactctgaaaaggtatggtgttctggctggcatcgtggggttcgcactgcttcttgctgtagacggctgggcacatagagtgaatattttctgttgggtggaaggaaaggaggtggtcagcgagagcgcttttccctccggtactcctgtccatgaaggcaccattcgcgtttttgctgaagacgcggacaggaaattgcttgaaggcagcactgacacacaagggcgttttcgtttccgcattcccaaacaagccatcgacaatgcctgggacctcagggtggagatcgatgccggcgtgggccacgtcaattcttggatggtccaggccagtgagtttgctaccagcggctcatcacctaaaaccactgcgagtcagtcgcaagccgcagggactgacaggacggacagggaggtggctgcttccaatgcggcggagttgaccccaaaagaactggaggcggcattggagcgcaagctgcgtcccattcaccagaaattgagccgtctggaacaggaccgcgtttctgtgcaggatgttgtgggcggtctcggctatatcctgggtctggcgggtatcgccctgtattgttctgcccggcgacggggttga

SEQ ID NO: 7707 - DNA, 315 bp, Methanosarcina barkeri fusaro
atgaatgaaatactgaatcttttcttgtctctgatagctggttttctgctcggagcagtgttctttggcggtctctggtggacggttcagaagggactttcatccagaaagcctgcgttctggttcctcggcagcctgttgatacggattagcattgtcatagctggattctattttgtctcggatggccattgggagagattgctaatatgcctgtttgggttttttgttatgcgtcatataatagttagacttaccagactgccagaggaagatcaaaatcaattgacaaaggaggccagtaatgcgacttag

SEQ ID NO: 7708 - DNA, 282 bp, Pelobacter carbinolicus
atgataccgactgaactcggtcgcatggccctggcgctgctcacggggctgttgttgggggcgggatatttcggcggactctacctgacggtgaaatccctgaagcgctgcgcttcgccacgactgttgctgacagccagcttcctgattcgactgctggtggtgctgggtgttttctatctcctgtccgattggggagcgctggtcatgctgacagccatgggcggatttctcatcgcgcgactgggttggcttcgatcgcgatatgggcggggagcgtag

SEQ ID NO: 7709 - DNA, 306 bp, Chlorobium luteolum DSM 273
atgacgagtgagatgctgatgggtctcctgccggaccttctcggggggctgctgctcggctcactgttcttcggcgggctgtggcttaccgtccgcagggggctcgcctctcccaggccgtggctctggttcgggctcagctcgctcctgcgcaccatgctcgtgctggccggtttctggtggctggccggaaatgactggcgggggttccttgccgcgctgctcggttttaccgcagcaaaggtcctggcggcagttctcagccgtaaatcgccgccctatgagggccaggcaaaggagggatag

SEQ ID NO: 7710 - DNA, 342 bp, Nitrosospira multiformis ATCC 25196
atgaatgaaattatgagtctgctactggcactggtcgggggagtgctgcttggggcattttttttcggtggactgtggtggacagtacgccgtagcattgcttctcctcgccctggaacatggtttgtcggtagcatgctgttgcgtacctgtattgtcactgccggattttattttttgctggaactggctgcccccggcaagaaaatcctgtttgccgccgtggtggggttcatcatagcgagagtagtggcaacccaatttctgcccacgccgttatccccatcgctggtccgaatggggcgaccgggaggaagtgcgatatccgccggagagcattag

SEQ ID NO: 7711 - DNA, 315 bp, Rhodoferax ferrireducens T118
atgaatgaaacgttgacactggccctcgcgtgggtggcgggcggagtgctcgggacaattttctttggcggcctttggtggacagttcgcaagggcgtctcgtccaaacaaccggcactttggttgttcagtagcctgctgctgcggataggcattgccctggctggattctattttgtctcgggtggtcattgggaacggctgctggcgtgtcttcttggctttgttgtggcacgcctggtcgtgacgtggatgacccgctcgtcgggcaaaaaccaaacgcgcccggcacgggaggctagccatgcgccttag

SEQ ID NO: 7712 - DNA, 282 bp, Pseudoalteromonas atlantica T6c
ttgttaatcggcctgctattagggtgcggtttcttttatgcgctctggttcaccgtccagaagggcttacagtcaccccttccagcagcatggtttttagggggtattttagcgcgaatggcaaccgccgtagcggttttttattgggtctcggcaaacgatatgtggcgtttaatcgcctgcttacttggatttgttatcggccgcttactgatgacgaaatggttaacacgctttcaaaattcacacaacgaaaaacgagaattgccccatgcacattag

SEQ ID NO: 7713 - DNA, 345 bp, Shewanella frigidimarina NCIMB 400
atggaaaacgtattggtagacaacatatttgtagagctcacattggcattactggcaggtgcattgctaggggtcttttttttcgccggactttggtggacggttcgccagctaaaatcgactcaacatgttgcgttgttatttatcgccagtctgttatttcgctccgccattgtgatcgctggcttctattttatcgctggcgacaatggataccatttattagccggattactcggatttatgttagtgcgcctcatggcaacgcgatacaccctgcaggtagagcaggctcaaccgttgagaaaaacacttatagtcgataaacaagaagaccgtttatga

SEQ ID NO: 7714 - DNA, 333 bp, Psychromonas ingrahamii 37
atgattgatcaaatattttatcgcgatatacagatacttcccctgctgccgttgctgcttgccggtgccgtattaggtgtgattttctttgccgggctttgctggacagtacagcgaggaattaaatccgcacaccctggccgttggttttttggcagttttttattgcgcacagcggtggctttaagcggtatttatctgctgactgacggacagtggccaaaattgttagcctgcatgctcggttttattggcgctcgtattgtcgttataacaataacaggctctgcaactaacattgcgaacaaacagaagcccaaccatgcgccttag

SEQ ID NO: 7715 - DNA, 321 bp, Polaromonas naphthalenivorans CJ2
atgacgatgaatgaaacgccggccctggtgctggcctgcatcgcgggcggcgcgctcggcgccattttctttggcggcctgtggtggacggttcgcaagagcctggtttccagccggcccgcgctgtgggtgtttgccagcctgctgctgcgcatgggcttgacgatggccgggttttatgtggtttcagggggcgactggcggcgcttgctggcctgcctggccggttttgtcatggcccggcaggtggtgacgcggctgacccggccgcttgatgcgcgccaggccctttcagaccaggaggcccgccgtgcgccttag

SEQ ID NO: 7716 - DNA, 357 bp, Marinomonas MWYL1
atgttaattgattttagcgacaacttttggggtggcgttgcctatgccatcttggttggcatgctattaggtgtgttttattttgcaggattgtggtggacagtgcgccgattgggttccagtcgcgtagttgcgccgttgtttctattcagtatgttgtttcgcattagcgtggtaatggtgagtttttatgtgtttctgggtaatgactggcagaaattattgttagctttacttggctttatggttttgcgtttgttcgcgacgcggctgattcgtttgaaagacaaccccgtcattatcaacccgattcacacgcttaaagaaaaacatcctcatacagaagagcgtttatga

SEQ ID NO: 7717 - DNA, 315 bp, Prosthecochloris aestuarii DSM 271
atgaatgatcttatggtttttgcagctcttttcttcgtcgggatgtttctcgggatattttttttcggtggattgtggttgacggttcaaaaaagtacgttctcacgaagaccgtggttatggttttcgatcagtctggcgttgcgaaccggagtcatttttgtggggttttatctgattgctcccggtggtctcgtgtggcttgtttcttcacttaccggttttgttgccgcaagggggctcgttatagtggtaacccggagttttcctgttcatcaggaacaaaaggaggtgccccatgcatctgagcggtga

SEQ ID NO: 7718 - DNA, 312 bp, Desulfomicrobium baculatum DSM 4028
atgaatgaaactttgacactggtcctggcgctggcggcgggcgttttgctcggcgggctgttctttggcggcctctggtggacggtcaggaaaggcgtttcgtccaagcggccggcgttttggttcttcgccagcctgttgctgagaatgggcattaccctgacagggttccattttatcgcgggcggtcatctgggcaggctgctgatgtgcctccttggttttttcattgcgcgccttgtcgtgacgcggctcaccagaacggtggaaaagccggcttgcctggcacaggaggccggacatgcgtcttag

SEQ ID NO: 7719 - DNA, 342 bp, Ralstonia eutropha JMP134
atgacccgcgtgcgccaggcccgccatgtcagcccgcgcgcggtgatcgccggcgctgcggtcctgctcgtcgcgatcatgctggcagccgccctcggccggctatacggacgccacctgaatccctcaggtcggctcggcgtgcccacgccaaccacgccggaggccacgttgccgctgtcggagagcgccccgcaaaccgaacgcgcgcgtttcgacgctgacaagcaggccgtgctcaaaggctggggctgggtcgacaagcgcgccggtgtcgcccatatcccggtggagcgggccatggcattgatggccgaaacaccgccggagcccgcacgatga

SEQ ID NO: 7720 - DNA, 393 bp, Nitrobacter hamburgensis X14
atgccgaatgaccggccggaatcacctgccgtcgcaacgcgcgccgtgctgttcacggcgataggatttctggtctttgtggggatatccctcgtcgtgctgcgcatcttttacggcgaacggaccggccacgtggtctttgtgccgccgaccctgtttgccaagccgcggcttcaaacaaacgacgccgccgatcttgccaggctgcaggccgaacaacgcggccggcttggcgggtatgcgtgggttgaccgggagaagggcatcatcgccatcccgatcgaagaagcgatgaaacgtgtcgtggcgcggggcgccgatgcctatgcgccgatcgattcgaacacttcagccaaacaacctgccggtgcaggcggaggacagtcgccgtga

SEQ ID NO: 7721 - DNA, 537 bp, Candidatus Koribacter versatilis Ellin345
atggacactaataatcattcgcatcccgcggtgaacaccgacgtcgggttcgacaagtcggacctgagcgttcgtggcatcgtcatctttcttgccggtgtcggcatcgccggcgtcgtatcgcacctggtgatctggggaatgttcgtcggcgcacagaaagtcgtgccctacgatcagaacccgaaccccatggcgacgatggtcaccggaactgaagcccctccgctgaccaatgccggtccgcagagcgtcgtcagcttccctgagcctcgtctccagaccgatgacaccgcggacatgagcaagtttaaggaagaagaagacaagcacctctacgcagctcatccgtatcagggcgccgacggcaccatccacctcaacatcaatgacgcgatggcgctcgtagcgcagcgtggcctgcccacccgccaagccggtcagcagcccaccgcgaccgccaacaccgataagcaaaccgctcccaagccagccgcaggcgcgaagcccgctgccggttcaccgggcgtgcagtag

SEQ ID NO: 7722 - DNA, 408 bp, Methylobacterium sp. 4-46
atgccggctgacgcctccccggagatccccgcccccccggaggccccgggcgtcccggtccggacggtgctcgccgccgtcgcgggcttcgcgctcttcgtcgccgccgccatgggcgggctcaagctctcctacgaccgcggcgccccgcggcgcgagcggccgccgccgcgggcgatgccgcagcccggcctgcagatcgacccggccggcgacctcaagcgcctcctcgacgcgcagggcgaggccctgtccggctatgcctgggtcgaccgggagcgcggcatcgtccggatcccggtcgcgcgcgccatggagatcctcgcgggccggggcgccgcggccctcgacccggtcggcgccccggcggcggcgcccggcccgatcaaggagagccggcggccgtga

SEQ ID NO: 7723 - DNA, 393 bp, Gluconacetobacter diazotrophicus PAl 5 JGI
atgcctgacgatcccgcccccgccgcgcccccgcatttttcccgcccccggcatgaagtccgggatgtggccctgcgcccggtcctcgtggtcggaatcggggtgggcgtggcggtggtgatgctggcggtgctggccaacatgctgtttccgcagcacacgctggacacggaactgcgtggccccctgccgcggatggccgcgcctgccctgcaaagcgacccgccggccgacatggcggccttccgcgcggcggacctggcacggctgaacgggttcggctgggtggatcgcgcgggcggggtggcccacgtgccgatcgaccaggcgatgcggcaggtggcgcgcgacggtattccggactggccatccgccggggcggaccggccatga

SEQ ID NO: 7724 - DNA, 405 bp, Methylobacterium nodulans ORS 2060
atgtccactgacgccgcccgcaaggatcagcccccggaagcccccggcgtcccggtcttgcgggtgcttggccccgtcttcggcttcgcggtcttcacgggcctgacgatgggcgcgctgaagctctactacgaccggaccaccctccctcacgggcaggttccgccgcgggcgatgccccagcccggcctgcagctcgacccgccgggcgacctcaagcgcctcctcgatgcgcagcatgagaacctctcccattacggctgggtcgaccgcgaccacggcgtgatccggatcccgatcacccgcgcgatggaaatcctggccggccggggagcggcggccttcgacccggtcggcgcccccgcttcggcgcccggcccgatcaaggagagccggcggccatga

SEQ ID NO: 7725 - DNA, 405 bp, Chloroflexus aggregans DSM 9485
atgagtcacgctaatgcccatagtgaaggcccttcagccgagagtttggcgctcaatcacgaagtgagtgatgcgcgttcgacaccggttatttggggtctggtcatcgtgtttggtacgttgctgctcgcctttgttctgatgggtctggtactgtctctaaccgccggctcgataaccgatgcgagtaataccctgagggacgatgaagtgacacagttgcaattaccaccagcgccgcggatcgagcagaatccacgaattgatggtgatcggattatcaccgaagcgaaagagcggctcgaaagttacggttgggtaaacgagcgagctggtcgggcacatatccctatcgagcgggcaatggaactcttgatcgagcacggtctcgataccgggaagtga

SEQ ID NO: 7726 - DNA, 432 bp, Pelobacter carbinolicus
atgcagcgactaggcggtctcggaacggcaggcaacggcctggagaaccatgccgatgcggaaatcaacatgatgcccctgatcgacatgattttcatcctgctgatcttcttcctggtcacggccagcttcgtacgggaatccggcatcgaggtaaatcgccccgaagcggtcaccgccgtgaagaaagaggcggtgggcatggtggtaggcatcgccggcgacggccgcgtcttcatcgatcaccaggtggtggatgtgaggcgggtgcgcggactggtggaaatctttctggcggaaaacgtcgacggcggcatcattatcgatgccgacagcgcctgcacggccggccgcatggtcgcggtcctggatcaatgccgcatggccggcgcgcagaatatcgccgtttccgcccgacgccccggagaataa

SEQ ID NO: 7727 - DNA, 411 bp, Desulfovibrio desulfuricans G20
atgcaaagcatccgctatacccgtgccgcccgcaacaggcgcagcgaagtcaacatgacaccgcttattgatatggtgttcatcctgctgattttcttcattgtgaccaccagttttgtgcgggaatccggcatagatgtaaatcgtcctgctgcccagtcggcggaaaccaaagaaaaagcgaacgtcatactggggctgaccagcgaaggcagaatatatgttgaaggcagaacgctggatatacgctccgtacgggcgtacatggaacggtttctggcggaaacccccgaaggatcagtcgttattgtagccgataaacagagcatgacgggcaacgcggtgcaggttctcgaccagtgccgtctggccggagtgcgcaacatcagcattgcggccaaaaaagaatga

SEQ ID NO: 7728 - DNA, 411 bp, Chromohalobacter salexigens DSM 3043
atgcgtaggcgtcgactacaggacgtcaacgacgacgcccaggagatcaacctcacgccgatgctcgacgtggtgttcatcatgttgatcttcttcatcgtgacgaccagcttcatcaaggaaagcggggtcgagatcgagcgccccgaatcgtcggccgccacggcgcgtcccgatgcccaggtgatggtcgccatcacggccgaggacgccgtgtgggtggatggtcagccggtggacgcgcaccgcgtgggcaacgaggtggccagcctggtcagcgacgagggtggggtcgtgatccaggccgatcgccaatcgaccacggggctgctcatcgaggtcatggatgccatccgcgacgccggcgtggatgacgtcgccgtggcggcggagcgaggcgccgacggatga

SEQ ID NO: 7729 - DNA, 387 bp, Campylobacter fetus 82-40
atgagacttgctaaaagagacggattaaatatagttccttttatagatattatgcttgttttgctcgctattgttcttagtatttctacttttattgccgaaggaaatattaaagtcgatttgccaaaagctcaaagtgctacaaatagcgatgaaagtgcaagagtgataatagctatcgataaaaattctaatatatttatagatgataaacttgttttagaaaatgagatcgcatataaaatatcaaatatcagtccagaaactttaattatattaagaagcgataaaagtagtaaatttgagtctttcattaaggttattgatgcattaaaaagtcaaaatcatgagaaatttgctatatctgctaaggtaagcaatgaatag

SEQ ID NO: 7730 - DNA, 405 bp, Psychromonas ingrahamii 37
atgaaattaagcaagaaaaattttcaacagcctgcccgatttgagttgttacccctgcttgatgtgatttttttattactgattttttttgtttttgttatgcttaaaatgactatgcaaagtagtattaatattgaattaccgcagttagttgatagccagcaacaaactgaggagctgttagttattagtataaacagcaaaaatcaactttttattaatgaggaagtaaccactgaagagcttatgttggcgcaagttattaacttgcaaaaagacaataaattacccatattaatacgtggtgacaaaaaatccgatttaggtgtcgccttatcaattttggataaactacgcttgtccggattccatcatgttgcttttgcaaccgacaaagaccaatga

SEQ ID NO: 7731 - DNA, 426 bp, Anaeromyxobacter sp. Fw109-5
atggccgcccactcgaacggcagcgacgaggcgatcaccggcatcaacgtgacgccgctcgtcgacatcaccctcgtcctcctcatcatcttcatggtcaccgcgtcgtacatcgtgaaggaggggatcgaggtcgacctgccccgcgccgcccacggcggcgagacggtcggcccgaccctggccttcgcgatcgatcgggacgggaagctctacctggacggtcagccggtcggccgcgacgcggcgcgcgcggccgtgcgcgcggcgctcgccaggagcgccgaggcgcgggcgctcatcggcgccgaccgggcggtgcctcacggcgaggtggtgtccgtcatcgatctggtgaagagcgaggggctgacgcgcttcgcgatccagatcgagcgggacgcctcgggagaaggcgcgccgtga

SEQ ID NO: 7732 - DNA, 420 bp, Candidatus Desulfococcus oleovorans Hxd3
atgctcaatatttcagcggcccggcgggccggaaaaagaggggtggaactcaacatggcgcccctgatcgacatgatttttatcctgttgatctttttcctggtgaccaccagttttgtccaggagaccgggctggacattgacaagccgtccgccgccaccgccgttgtccgggaaagcgctgacctggtgatcggcattacccgtgagaaccggatttttatgggcagacgggagattgacgcggaccgcctgcgcctggccgtggaacgggcgatcacggaaaagcccgaagccgaggtgttgatcgtggccgacacccagagcgccaccggcacggtgatcgaggtgatggatgcctgccggctggccggggccagggccatatccatggccgcgggcataccggaacagcaatga

SEQ ID NO: 7733 - DNA, 423 bp, Anaeromyxobacter sp. K
atggccgcgcactccaacgaccccgacgacgcgatcaccggcatcaacgtgacgccgctggtggacgtcacgctggtgctgctggtggtcttcatggtcaccgccacgtacgtggtgaaggacggcatcgacgtggacctgccccgcgccgcgagcggcggcgagtccaccggccccacgctcgcgttcacgctcgaccgcggcggccacctgttcctcgacggcgcgccggtggagcgcgacgcggcgcgggcggcggtgcgcgccgcgctcgcccggagcccggaggcgcgcgcggtcatcggcgccgaccgcgcggcctcgcacggcgcggtggtgtcgctcatcgacctggtgaagaccgaggggctcacccgcttcgccatccagatcgagcgcgaggacgcgggagcggcgcggtga

SEQ ID NO: 7734 - DNA, 423 bp, Anaeromyxobacter dehalogenans 2CP 1
atggccgcgcactccaacgaccccgacgacgcgatcaccggcatcaacgtgacgccgctggtggacgtcacgctggtgctgctggtggtcttcatggtcaccgccacgtacgtcgtgaaggacggcatcgacgtggacctgccccgcgccgcgagcggcggcgagtccaccggccccacgctcgcgttcacgctcgaccgcggcggccgcctgttcctcgacggcgcgccggtggagcgcgacgcggcgcgggcggcggtgcgcgccgcgctcgcccggagcccggaggcgcgcgcggtcatcggggccgaccgcgcggcctcgcacggcgcggtggtgtcgctcatcgacctggtgaagaccgaggggctcacccgcttcgccctccagatcgagcgcgaggacgcgggggcggcgcggtga

SEQ ID NO: 7735 - DNA, 429 bp, Desulfohalobium retbaense DSM 5692
atggcctccggtaggcgctaccgccaaagcgacaagcgttcgcagaccgagctcaatctgacaccgctgatcgacatggtctttattctgctcatattttttctggtcacttcgcatttcgcccgcgaaaccggcatcgaggtcagccgtcccgaggcggcctccgtggagtcggccccggcacaacacctgcgtatcaccatccgggccgacaaccagatttttatccgcggccagcatgtcgatatccgccgcctgcaagagcaccttgaaagccgtcttcgcgaccagccactccaggccgccgtggtcacagcagacgaagccagtcgatccgggaccctggtccaggtcctggacgcctgccgcctgagcggactcgacgacgtcaccgtcgccggccgccgtccggaggaaagcggaccatga

SEQ ID NO: 7736 - DNA, 630 bp, Nitrosococcus oceani ATCC 19707
atgaactttcaacccagccctttacaggcattaatcttgtggcggttactgactagcgaaggacgagcctacctgaccgatatccgtcctaaacccaagcggcgcgaccgggaagccctgctagaggcgaaatttatcgaagaacaatggcgacgcaaaccccagggcagccgggcaatctatgtccaactcaccgatagagcctgggcttgggccggagaacatatggatgccaaactctcccatcggtccccggcggcaggccctatcctccagagctttcttgcccgcttgcaacccatcctgcaaagtcgacatatcacgctggcggaaatttttagctcaactcaagcgcctcccccaagcgaagattcggaacaacagctacgggaggcctatttccatctctctggcggcgagaggaatattcgagttcggctcgctcaactccggcaacagttaggagctattcctcgtcccagactagacgaattattgctgaaattacaaagggaaggaaaattggtgctgtctcctctcgatgattcccgggaaattttaccggaggaccaaaaagcagccctaagtgtcgccggatttaagcggcatctggtgtatatgcaaaaataa

SEQ ID NO: 7737 - DNA, 717 bp, Rhodopseudomonas palustris BisB18
gtggcagcatctcgcaaatccaaacacccgaagcccgctgacaaaccacgccccaagactcgcgagcagaaagacgcggaaaagcaagcgctggcgatgtgggcgctgctcggcgccggcggcgccggttacggccgcaagctgaagccggagatcgagaaggccgaacgcgaggcgttgatcaaggccggcctgatcgagtccaggccgcgtgaaaaccgcgcgttgtggctcaccgtcaccgacagaggctgggactgggcggagcggcacctcggcgatccgctgccggagaaaaattacagcggcgccttcgtgttgcaggcgtggctgacgcggctcaaaacctacctgcaggcccgggatctgcgcctcgccgatgtgttggctgcgtcggctgttcctgatcctggcggaagcgccgaggctgacgaagcgcccgcgcctgccgatccggccgagctgcgcgaaaaaatccgcaacgcctatctggcggtcgccggcggcttcaaccgccgcgccttgctgaaggatctgcgggcgaaactgccggagatcgacagagcaacgctcgacgacgcgctgaagcagatgcagcgcgagcagcaggcctcgctgatgcagctcgacaatcgaatcgacgtcaccgatgccgaccgcgacgccgccattcaaatcggcaacgagccgcgccacatcgtctggatcgagaactga

SEQ ID NO: 7738 - DNA, 618 bp, Mycobacterium vanbaalenii PYR-1
gtgactgtgacggcgacggacctgaccggaaccgaacgagcggtgctgctggtgctgatggccgaatcgcggccggtgcccaacccggaactggcggcgctgggacctgcgctggacaaacccggccgcgacaaactcaaccggctcggcctgatcgaatccgagcgggtcgggaacaggttcgtccacgaactgaccgaccgcggctggcggctgtgccgcgacctgctcgccgccggcgcgccgccgcgctcgaccgggcctgccaagaccctctacacggtgctcggcgcgctgggccggtacctgcagcacaccgacctgagcctggccgacgtgttcggtgctgctgagccgcctgccagcgtcgaggagcgcatccgggccgcctacgacgtgctggcaacccggcccggcggctgggtgtcgctgacccggctgcgcgccgaactcgacgcaccccgcgccgacgtcgacgccgcgctggtcgcgctgcaccgcacgccgggggtcagcgtgatccctgaagagaaccagaagacgctgaccgccgaggatcgcgccgcggccgtggtcatcggggaccggcccaagcatctgatcgcgatcgaggcgtga

SEQ ID NO: 7739 - DNA, 621 bp, Mycobacterium gilvum PYR-GCK
gtgagtgtgacggcgggggagctgacggggaccgaacgtgcggtgctgctcgtcctgatggccgcgtcgcgcccggtgccgaatcgggaactggcggtcctgggccctgcgctggacaaaaccggccgtgacaagctcaatcgcctgggcctgatcgaatccgagcgcgtcggaagcaggttcgtccacgagctcaccgaccggggctggcgactgtgccgggagctgatcgacgcaggtccgccgccccgctccaccggtccggcaaaaactctgtacaccgtgctgggtgcactcgggcgatacctggacggtgcgggcctgagtctggccgacgtgttcggagcctcgcacggcggccctgcgcgcaccgaggaccgcatccggacggtctacacccgcctcgcgggccggcccgggggctgggtgtcgctgaccgcgctgcgggccgagctggacgccccccgcgccgaggtggacgccgcgctggccgtgctgcaccgcacccccggggtcagcgtgatcccgcaggaggaccagaagctcctgacccccgaggaccgcgacgccgcggtgatcatcggggaccgccccaagcatctgatcgcgatcgaggactga

SEQ ID NO: 7740 - DNA, 813 bp, Frankia EAN1pec
atgacccgcgacagctcggcgtcccgcggcggctcggccacccgcgacgcgacggcgctcaccgtccggcaggcagcgatcctgctggctctgctcacccagacccagcccatctccaacagcgagctgcgggaccggttcgatttcaccctggtcggcgacgaccggcgtcgcctcaacgaacttggacttgtcggcagcaaaaagattcgcggccatggcaacgtcctcttccacgagctgacggacgccggctggaacagggcgtcgcgggagctgaccccgagtgccgagttcacgaggctcagcgtgcccgccggcgtcttcttcgcgttcgctgagggggtggcccggctcctcgtgcgtgagcagcgggcgattggcgaggcgcttggcgcgtacgccgggccacccgatccgggctcagatggttcgcccgaggcggatccggccggaaccggtccgctgtcggcggcctccgcgcccaagacggctacggcggagacggagatggaggcggacgcggaggccgatcggagcgggaatcccgccagcctggaaacgacgattcgggcggcgtatgccagcctggcgaccgacgctcacgactgggtgcggctggccgacgtccgaccgctactcggaggcgtcgaccggaaacaggtcgacagggtgctgcggcagatggcccggcggcccgacgtgcgggtggtgccggacgaggaccagaagtccctgactgccgctgaccgcgcggccgcggtccgcatcggtgagcacgacaaccatctgctgttgatcgggccggtatga

SEQ ID NO: 7741 - DNA, 849 bp, Methylobacterium sp. 4-46
atgagcgagaccctgacgccccggcgcgggctgatcctgtggtgcctgctcgggaggcagggctcggccctgcagagcgaggtgcggcccgcggtcgcgcggctcgaccgggaggccctgatcgagcgcgggctcgtcgcggcggagaagcaggggcgctcgctccggctgaccgtgaccgagcggggctggcgctgggcgagcgaccacctgcacgcgccgctccccgagacgttccgcgtgctgcaggattggctggggctggtcgcgcgccacctcgacgcgaccggcgccacgctcgccgacctcgtgggcgaggccccggcgcccacgcgggaggccctgccggcgcggcaggcgaggatcctgcgggccctgatcgacgcgcagggatccgcctcgccgcgcgacctcaagccggcggcctcccgggccgaccgggaggcgctggtggcggccggcctcgtcgcgcaggagccgcgggggcgctccgtccggctcacggtcacggaggcgggccggcactgggcgcggacgcatctcggcctggcgctgccgggggggcaggaggcggcgcccgcgcccgccgcgctcgagcggatcgaggcggcctacctcgcgctcacggacgggcgccggcgcgaggcggtccgcctcagccgcatccgggcggaactcgccgatctcgaccgggccagcgtcgatgccggcctcgccctgatcctgcgggagggccgcaaggcccgcctgatgcagatcaccgatccgcgcggcctcgacgccgccgagcgggcggcggccttcagcccggccggcgagcccttccacctcctctggatcgagccatga

SEQ ID NO: 7742 - DNA, 603 bp, Actinosynnema mirum DSM 43827
gtgatcgaggagcggctgaccccgcacgagcgggcggtgctgctcgtgctcatggcggaggcccgcgagctgaccaacccgcagctgcgggaggtcgccgggttcaccctggacggggcggccaggcggcggctcaacgggctgggcctggtgacgagcacgaaggtgggccggggtttcgcgcacgagctgaccgaccggggcgcggtgcgctgcgccgaggagctgaccgcgccgaggcagccgaggtccgggtctgccggtggcgcgctggcggcggtgctggcgggcctgaagcggcacctggacgcgaccgggggcacggtggccgaggtgttccggcccgacccggtggtgctggtgctcgcggcgcacgacgcggcgagcggcggccggggcggttcggtgccgctggcggacgtgcgggagcggctgctcggggtgccgcgcgcggacgtggaccgggcgctgggcgagctggcgctgcgcgaggacgtgcgcctgtggggcgaggcggaccagaaggcgctgaccgaccgggaccgcgaggcagcggtcgtgctgggcgggacggcgcggcacctgctggtcgtggcgcggtga

SEQ ID NO: 7743 - DNA, 465 bp, Nitrobacter winogradskyi Nb-255
atgatccactcgacggccgccgccgacaggcacctccacctaatcaaactcgccgtgggctgcgaatccgtaaaggaactcagggattggatcgccgaacgtatgaagcaggcgacgctagaaggcttgccgcgccatcatattcacatcacccggatgacaccgaaacgcggcgaggagttgctcgcgggtggctcgctttattgggtcataaggggtgaaattgcggcccgtgagaagctgatcggcatcgagcccttccgcgacggcgacggtattggtcggtgccgtctggtcatgcagccgaaggtggtcgccgtcaggccgcgcccgatgcgcccctttcaagggtggcgttacctgtccctcgccgatgctcctcccgacctcggaagcaacgccgcgagcgtcgcagagatgcccgagccgctgcgccgcgagttgcgcgatctggggttgctgtaa

SEQ ID NO: 7744 - DNA, 438 bp, Rhodopseudomonas palustris HaA2
atggcgctcaatctgatcaagctggcggtcggctgcgagtcggtgaaggacctgaccagccgcgtcgccgagcgcgccaagctcgcgcgccagcaggggctgccgcgccagcatgtccacatcacccggatggtgcccaagcgtgacgccgaactgctcgacggcggttcgatctactgggtgatccgcggcgagatcgctgcgcgcgagaagctgatcggcatcgagccgtttcgcgacggcgacggcatcggccgctgccggctgatcatggagccgaaggtgcatgccgtcagcccacggccgatgcggccgtttcagggctggcgctatctcaccaccgccgacgcgccgcccgacctcggcaaggccgccgagagcatcgccgcgatgccggagccgatgcgccgcgaattgcgcgaactcggattgctctga

SEQ ID NO: 7745 - DNA, 438 bp, Rhodopseudomonas palustris BisB18
atgccgcttcatctcatcaagctcgccgtcggctgtgagtcggtgaaggactttgaaagccgggtctcggcccgggccaagctcgccaaggcgcaaggcctgccgccgcggcatatccacgtcaccaggatgacgccgaagcgcgatgccgaactgctcgatggcggctcgatctattgggtgatccgcggcgaaatcgctgcgcgggagaaaatcgtcgcgatcgagccgttccgcgacggcgacggcatcgcgcgctgccggctgatcatgcagcccaaggtgatcgcggtggcgccgcggccgatgcggccgttccagggctggcgctatctggccgcgaccgacgtgccgccggacctcggcagcgccgccgccagcatcgccgcgatgccggagccgatgcgccgcgaattgcgcgatctcgggctgctgtag

SEQ ID NO: 7746 - DNA, 438 bp, Rhodopseudomonas palustris BisB5
atggcgcttcatctgatcaagctggcggtcggctgcgaatcggtcgacgacctgaccagccgcatagccgatcgcgccagactggcgcgccagcaggggctgccgcctcagcacgtccacatcacccgcatggtgccgaagcgcgacgccgagctgctcgatggcggctcgatctattgggtgatccgcggcgagatcgccgcgcgcgaaaagctgatcggcatcgagccgtttcgcgatggcgacggcatcggccgttgccggctgatcatggagccgaaggtccatccggtgaacccgcggccgatgcggccgttccagggttggcgttatctcaagacgtccgacgcgccgccggacctcggcaaggccgcggagagcatcgcggcgatgccggagccgatgcgtcgcgaattgcgcgagctgggattactctag

SEQ ID NO: 7747 - DNA, 456 bp, Nitrobacter hamburgensis X14
atgagagctgccgctgatatccacctcaatctcgtcaaactcgccgtcggctgcgaatccttgaaggaattcaggaactggatcgccgagcgcatgaagcaggcaaaacggaacgggctgccgcgccaccatatccacatcacccggatgacgccgaagcgcgacgaggaattgctcgcgggtggctcgctctattgggtcatcaagggtgaaatcgccgcccgggagaaactgatcggcatcgagccgttccgcgacggcgacggcatcggtcgatgccgtctggtcatgcaaccgaaggtgattgctgtcaggccgcgtccgatgcgtccgtttcaggggtggcgctatctgtctgccgccgatgcgccgcccgacctcggcagcaatgcggcgagcgttgccgcgatgcccgagccgatgcggcgcgagttgcgcgatctggggttgctgtaa

SEQ ID NO: 7748 - DNA, 441 bp, Bradyrhizobium BTAi1
atgccgctgcatctgatcaagctggccgtcggctgcgagtcggtcaaagagctgaaggaatggatcgcggagcgcatgctcgcggccaagaagaagggcctgccgcaacagcatgtccatgtcacgcgcatgactccgaagcgggtcgacgagatcctcgccggcggctcgctctattgggtcatccgcggcgaggtcgccgcgcgtgagaaaatcgtgggcatcgagcccttccgggatggcgacggcatcgggcgttgccgcctgatcatgcagccgaaggtgatcgcggtgtcgccgcggccgatgcggccgttccagggctggcgttatctcacccccgaggacgcgccggccgatctcggcaaggccggcgctgcggggctcgaagccatgccggaaccgctgcggcgcgagttgcgcgatctcgggctgctgtag

SEQ ID NO: 7749 - DNA, 435 bp, Xanthobacter autotrophicus Py2
atgacgctccatctcatcaagctgtgcgtgggcgcgacctccatcgccgacctcgaagactggatcgcccagcgggccgaggcggcgcgcaaggcgggccagccgttcgagcagatccatgtgacccgcatggtaccgacccggcgcgaggaactgctggacggcggcgcgctctattgggtcatcaagggcgaggtggcggcgcgccagcgcctcctcgacctccgcccgttcgtggacggcgacggggtgcgccgctgcggcctcgtgctcgacccgcaggtggtgccggtggagccgcgtccatcgcggccgttccagggctggcgctacctgaaggcgagcgaggcgccgcgagacctcgcccagcctgaggatggcggggcgttgcccgagggcctcgcccgagagctgcgcgagctggggctgctgtga

SEQ ID NO: 7750 - DNA, 420 bp, Rhodopseudomonas palustris TIE 1
atggcactgcatttgatcaagctcgcggtgggctgcgagtcggtgaaggatctgaccgagcgggtggccgagcgcgccagatcgggtgggcggcacatccacatcacccgaatggtgccgaagcgggacgcggagctgctcgatggcggctcgctgtattgggtgatccggggcgagatcgcggcgcgcgagaagctggtcgcgatcgagccgtttcgcgatggcgacggcatcagccgttgccgcctggtgctggagccggaggtgcacccggtcagcccacggccgatgcggccgttccagggctggcgctatctcaccgcttcggatgcgccgcatgacctcggcaatgcagccgaggggatcgctgagatgccagagacgatgcgccgcgagctgcgcgaactcgggctgctgtag

SEQ ID NO: 7751 - DNA, 324 bp, Nitrobacter winogradskyi Nb-255
atgctcgatcgcgatgaggatattctgaaggcggcggaaagttgggcggaggcgggcaaaggcgttgcgctggcgacggtcgttgagacctggggctccgcgccacgtccggcgggctcgggtcttgtggtcaacgaagacggaacgtttctgggctcggtgtcgggcggctgcgtcgaaggcgccgtggtgaccgaggcgctcgacgtgatctccagtggagcgcccaggatgctggagttcggcgtagcggatgaggcggcgtggactgtcggcctgtcatgcggcggcaggatccgcgtatttgttgagaaagtggtgtag

SEQ ID NO: 7752 - DNA, 324 bp, Rhodopseudomonas palustris HaA2
atgctcgaccgcgacgaagacatcctcaaagcggcggaagactggaaaaaggccggccatggcgtcgcgctcgccaccgtggtcgagacctggggctcggcgccccgccccgccggctccagcctggtgatcaacaatgatggcacctttctcggctcggtgtccggcggctgcgtcgaaggcgcggtggtgaccgaagcgctcgatgtgatcgagagcgggcagccgaagctgttggaattcggcgtggccgacgagaccgcctggaaggtcgggctgtcctgcggcggcactatccgggtgttcgtcgaaaaggtcggttag

SEQ ID NO: 7753 - DNA, 324 bp, Rhodopseudomonas palustris BisB18
atgctcaatcgcgacgacgacattctgcaagccgccgaggactggcgcaatgccggccatggtgtcgcgctcgccaccgtggtcgagacctggggctcggcgccgcgaccggccggctccagcctggtgatcaacgacgacggcacgtttctcggctcggtgtcgggcggctgcgtcgagggcgcggtggtcaccgaagcgctcgacgtgatcctgagcggagcgccgaagctgttggaattcggcgtcgccgacgagaccgcctggcaggtcggcctgtcctgcggcggcaccatccgggtgttcgtcgagaaggtgtcgtag

SEQ ID NO: 7754 - DNA, 324 bp, Rhodopseudomonas palustris BisB5
atgctcgaccgcgacgaagacattctcaaagcggcggaagactggaagaacgccggccacggcgtcgcgctcgccaccgtggtcgagacctggggctcggcgccccgccccgcgggctccagcctggtgatcaacaatgacggcggctttctcggctcggtgtcgggcggctgcgtcgagggcgcggtggtgaccgaggcgctcgacgtgatcgagagcggccagccgaagctgttggaattcggcgtcgccgacgagaccgcgtggaaagtggggctgtcctgcggcggcacgatccgggtgttcgtcgagaaggtcggctag

SEQ ID NO: 7755 - DNA, 333 bp, Nitrobacter hamburgensis X14
gtggccgccatgctcgatcgcgatgacgatattctgaaggcggccgaggactggcagaaggccggccacggcgttgcgatcgcgacagtcattgagacctggggctcggccccgcgcccggcaggatcgagcctcgtcgtcaacgacgagggcacgtttctcggctcggtctccggcgggtgcgtcgaaggcgccgtggtgaccgaggcgctggacgtaatctccagcggcgtgcccaagatgctggagttcggtgtcggtgacgagaccgcgtggactgtcggattgtcctgcggcggcaccatccgtgtcttcgtcgagaaagtcggctga

SEQ ID NO: 7756 - DNA, 315 bp, Rubrobacter xylanophilus DSM 9941
atgaacccggtggtggagagggtcgctcggtggcgcgaggaggacaagaggtgcgccctggccacggtggtcaaggtcgagcgctcggggcctttggggccgggcacctcgatggctgtcagcgaggacggcgaggtggtgggctcggtcagcgggggctgcgtggagccggccgtctacgaggaggccatgagcgccatccagaccggcgagcccaggctcctcacctacggcatctccgacgaggaggccttcggggtggggctcacctgcggcggggtgatccacatcttcgtcgagagggtggactggtag

SEQ ID NO: 7757 - DNA, 339 bp, Mesorhizobium BNC1
atgccgcaaagcgtagaaacccatgagccgcgcgatccccttttgatcgccgaggaatggatgaaggacggcaaggatgtggctgtcgccacggtcgtggagacatggggttcggccccgcgtccggtcggcagccatctggtcatcgattccgaaggcctgttcgaaggctccgtttccggtggttgcgttgagggagcggtgattgccgaagcggctgaggtgatcgccgacggcaaaccgcgcatgctggaattcggcgtggcggacgagaccgcttggcgcgtcgggctttcctgcggcggccgcatcaaggtctatgtggagcggctgggctga

SEQ ID NO: 7758 - DNA, 333 bp, Acidiphilium cryptum JF-5
atgagcgacaccgcatccgacgccgaggacattctcggaatcgccgccgcctggcacgaggaaggcgagcaggtggccatcgccaccgtcaccagcacctggggcagctcgccgcggcgcgtcggtagccgcatggccgtcaccgcctccggccgcatcgccggctcggtctccggcggctgcatcgagggcgcggtggccgaggccgcccagcgcagcatcgaaaccggcacgccgcagcgcctcgattacggcgtcaccgacgaacgcgcctgggaagtcggcctcgcctgtggcggcaaggtctcggtcttcgtggaaaagctctcgtga

SEQ ID NO: 7759 - DNA, 324 bp, Bradyrhizobium BTAi1
atgctgaaccgcgacgaagacatcctcaaggccgccgaggactggcgcacatccggccatggcgtggcgctcgccaccgtggtcgagacctggggctcggcgccgcggccagtcggctccaatctggttatcaatgacgatggcacgttcctgggctcggtatctggcggctgcgtcgagggcgccgtcgtcaccgaggcgctcgacgtgatctccagcggccagccgaagatgctggagttcggcgtcgccgacgagactgcctggaatgtcggactgtcctgtggcggcaccatccgcgtgttcgtcgagaaggtgggctga

SEQ ID NO: 7760 - DNA, 333 bp, Sinorhizobium medicae WSM419
atgcagaacgagccgaacatcctcgatccattggcggtcgctgaaacctggcacgagcaaggtcgtgccgtggcgctcgcgaccgtgatcgaaacctggggctcggcgccccgtcccgtcggcagccatctggtaatcgacggggaaggcaatttccaaggctccgtttccggcggctgcgtcgagggcgcggtcatcgcggaggctgccgacgtgattacgtccggtaccccgcggcttctcgaattcggcgtagccgacgaaaccgcatggcgtgtcggcctgtcctgcggtggccggatccgtgtctatgtcgaacgaattgacggctga

SEQ ID NO: 7761 - DNA, 336 bp, Parvibaculum lavamentivorans DS-1
atgaccgaacccgccgcaaaccacgatcaggtgctggaggaggccgcccgctggcgcgcggagggccacaaggtcgccctcgccactgtcattgaaacctggggttcggccccgcgtccggtcggcagccagctcgccatccgcgacgacagcgaattcgtcggctccgtctccggcggctgcatcgaaggcgatgtcgtcacccgcgccctcgacgcgctcgccaccggcaagcccgaaatcgtcgaatatggcgtcagcgacgccatggcctgggaagtcggcctcgcctgcggcggccgcatccgcgtcatggtcgaaccggtatcgggctga

SEQ ID NO: 7762 - DNA, 327 bp, Rhodopseudomonas palustris TIE 1
atgcagctcgatcgcgacgaagacatcctgcgggccgccgaggactggcgcaaagccggccgcggcgtggcgctcgccaccgtggtggaaacctggggatcggcgccgcgtccggccggctccagcctggtgatcaatgacgagggcacctttctcggctcagtgtcgggcggctgcgtcgaaggcgcggtggtcaccgaagcgctcgatgtgatcgacagcggcacgccgaagctgcttgaattcggcgtcgccgatgagaccgcctggaaggtcgggctcagttgcggcggcaccatccgggtattcgttgaaaaggtcgattag

SEQ ID NO: 7763 - DNA, 324 bp, Methylobacterium sp. 4-46
atgctctccaccgacaccgacatcctctcggccgcgcaggcctggcgcgaggccgggcgcggcgtggcgctcgccaccgtgatcgagacctggggctcggcgccccgcccggtcggcagccacctggcgatcgaccaggagggcaatttcctcggctccgtctcggggggctgcgtcgagggcgcggtgatcaccgaggcgctggaggtgatcgaggaggggcgcccgcgcgtgctggaattcggcgtcgccgacgagaccgcgtggcgggtcgggctgtcctgcggcgggcggatccgggtgctggtggagcgggtcgcgtga

SEQ ID NO: 7764 - DNA, 324 bp, Methylobacterium nodulans ORS 2060
atgctctccaccgacaccgacatcctctccgccgcgcagggctggcgcgaggccgggcggggcgtggccctcgccaccgtgatcgagacctggggctcggccccgcggcccgtcggcagccatctggcgatcgaccaggagggcaactttctcggctcggtttcggggggctgcgtcgagggcgcggtgatcaccgaagcggtcgaggtgatcgaggacggccgtccccgcatcctggaattcggcgtcgccgacgagaccgcgtggcgggtcggcctgtcctgcggcgggcggatccgggtgctggtcgagcgggtcgattga

SEQ ID NO: 7765 - DNA, 570 bp, Brucella suis 1330
atgaccacaaaccgcaaatggctctatgcaggcgccgttctcgccgcgctccttcaaaccggcattctttatgccggtattgaaaagcgtgccgctatattgcgttccggtcaggatatcgttttccagacggagccggtcgatccgcgcgatcttatgcggggtgattatgtcgttctgggatatgaaatatcaaatatcgcccggagcgccattcagggcgtccgcccggccggttcacgcaccgtttatgttgccgtgaagccggatgccaagggcatttcacgtttctcgcgggcgtctttcgtgccgttcaaggacctcgctgccggcgaaacccagattcgcggcgaagcgggctatgagatcagtgatgatccggaggcgaatattcgcctcagttttggcattgagcgatattatgtgtcggaaggtgaaggccaccccattgagggtagccagcgcgagcacgatattacggtgcttgtagcggttgatgcgtccggatcgccggtcattaaggcgctcatggatgaaggccagccactttatgaggagccgctttattga

SEQ ID NO: 7766 - DNA, 570 bp, Brucella ovis
atgaccacaaaccgcaaatggctctatgcaggcgccgttctcgccgcgctccttcaaaccggcattctttatgccggtattgaaaagcgtgccgctatattgcgttccggtcaggatatcgttttccagacggagccggtcgatccgcgcgatcttatgcggggtgattatgtcgttctgggatatgaaatatcaaatatcgcccggagcgccattcagggcgtccgcccggccggttcacgcaccgtttatgttgccgtgaagccggacgccaagggcatttcacgtttctcgcgggcgtctttcgtgccgttcaaggacctcgctgccggcgaaacccagattcgcggcgaagcgggctatgagatcagtgatgatccggaggcgaatattcgcctcagttttggcattgagcgatattatgtgccggaaggtgaaggccaccccattgagggtagccagcgcgagcacgatattacggtgcttgtagcggttgatgcgtctggatcgccggtcattaaggcgctcatggatgaaggccagccactttatgaggagccgctttattga

SEQ ID NO: 7767 - DNA, 570 bp, Ochrobactrum anthropi ATCC 49188
atgactattcggctcaaatggctctatgtcggggcaaccgtcactgcattgctgcaaaccggcattctttatgcaggcatagaaaagcgcgcctctgtcctgcgttcgggtgcggaagtgacgctgcagacggagcctttcgacccgcgcgatctgatgcgtggcgactatgtcgttctggggtacgagatttccagtctgtcccgaaaggatattcagggcgagcgtcctgccggttcgcgaaccgtctatgtggccgtgaagcccgatacaaacgggatagcgcggttttcacgcgcgtcattcgttccgctttcagaccttacctccggtgaggagcagattcggggcgaggctgcttattccatatccgatgatgcggaatcgaatattcgtctcaattttggcattgaacggtattatgtacccgaggggcagggacgtgcgattgaagacagccagcgcgagcggcggattactgccgttgtggcggtcgatccgaacggaacgccggtcatcaaagccctgcaggaagacggccggcagctttatcaggagcctctttattga

SEQ ID NO: 7768 - DNA, 525 bp, Campylobacter curvus 525 92
atgaggcttaagctggtcctcggtgctgtgatatttcaaattttagctttgctagcgatgctggtaaatgcctttgcaccgctttattttggcaaagatatacgcgtggatgtcagcctttatgatccgcgcgatcttttacgcggaaactacgtgagcttgcagtatgattttaccaggaatttgcctatatttcacggagcttatgacgaagaggtcgatgaaaaccaaagcataggcaaagataaaatttacgttagtctaaagcccgatgaaaacggaacgtatcaaagcgacggatatagctttgaacgaccaaaagatggcgtttttatagtaggctcgatggattatgaaggagcgaaatttggcatcgaggcgtttttcatgccgcctcaaaaagccatacaaatggaaaaggatataagagagagcggagcgtatgccattttagccgtgatggataacggcaaggcgcgcgtcaaagatatagtgcctaagggcaaattttatattaaattttaa

SEQ ID NO: 7769 - DNA, 600 bp, Parvibaculum lavamentivorans DS-1
atgaacgcccgcttcggcctcgccctcatcgccctcgcgctcgggcaatcgcttttcctcgctgtcatggtctgggaccgcgtctcgctgctccgctccgaaagcgtcgtcacattgaagacagagcccgtcgacccgcgcgatctcttccgcggcgactacgtcatcctgaactacgaaatatcgcgcctccgcctcgacacccttgaaggcgacgatggcttcgcgcagggcgacacgatccatgtcgaactcgcgcccgccggcgatctctggcagcccgtcgccgcatggcgcgaccatcgcgaaccggcagcgggaaatgaaatcatccgcggccgcgtttcctgggtcatcgacgcccgccccgtggcctcgcccgccgatggcgaagaaatgccctgcctcgattgcggcaccgccaccatcgcctatggcatcgaaagctacttcgtacccgaaggcgaaggccgctcgctggaggaccagcgcaacgctggaaatctcaccgtcgatgtggcgctcggcagagacggcgaaggggcgatcaagcgccttcgtctcgaaggcgaacccgtctacgaggaaccgcttttctga

SEQ ID NO: 7770 - DNA, 651 bp, Campylobacter concisus 13826
atgaagataagatcactgatactagccataatctttcaaattttactaataattgcgatgcttgcatacgcgctcatgccactttatcttggaaaagagataaaagtgagggtaaatctctacgatccaagggatctctttcgcggaaactacgtgagcttgagctatgatttttcagatttttcaaatttacagcagtctaaatttgatgaaaaaactggcgttgagatatatatatatgatagaaatatctcaaaaaatgatgaaatttacgccattttaaagcaagatgctaatgctacttacgcttttgataaatttagctttactaagccaaaagacgctcttttcttagctggcaaatttgatggatatttatttgtaaaatatggcatcgaagagttttatatgccaactaaaaaggcaaagcagactgagcgagagatgatggatcaagacgtggatgctgttgctgttttgatggtgatggatgatggcagagcaaggctaaaagatctcatcatcacgccaaatggcaaaaaaagaagcaatgatgaaaattttgatgaaaatggctacatagatgacaacgagagtatagatgataacgagagctttgaagagccagttcgcttgcaagatcaaaggtaa

SEQ ID NO: 7771 - DNA, 552 bp, Shewanella sediminis HAW-EB3
atgaataccatgaccgttcctggttggctgcataagaagcccggtaaacgaacgatacaaatcgggcttattctaacccttttttttcaactatctgttttgagcatcgaatacctgggctccgttttacccatatggacaggtgaagagatcatcttaaagactgagcccgttgacccgcgtagtctgtttcgtggcaattttgtgcgtttaaactacgagattaaccgcatcccgactgagccccaaacagagtttaaaatgggtagtctgatctacgttagtctggttgagataaatggtatttggcagttcgataccttcaatacagctaagccgaagatgggaacctatattcgcggacgagtacgcagagtcgactccggtacagttcgggttgagtatggcattgaggcattttttatgcccaaggagaaagctttgaaagtccaaaatgagatgggcggtcaggcgcaggttcgggtatttgtcgcccctaatggtaaggctcgtgcggtggggtttaaatgtctgggtgatgcgtgtttataa

SEQ ID NO: 7772 - DNA, 573 bp, Shewanella woodyi ATCC 51908
atggagagtttagtgacgccattattaagaaaaggcagcccaagcaaaaggtttgtccagattggcttgttcttgactattttgtttcagctttcagtgttgtgcgtggagtatttaggtgctgtttggccaatttggactggcaaggcggtggtattaaaaactcagcctgtggatcccagaagtttgtttcgaggtaactatgtgcgacttaattatgatatcagcagggttgagcgtaaagatgccgaagcctttaaattaggcagtgtggtttatcttactcttgaggagaactctggcttgtggcaagccaaagaggtaacacgtgatatgcctagtgaaggggattttattcgcggccgtgttcggagtcactatggtgaagtgctcagcatcgattacggcattgaagctttctttatgccaaaagagaaagcgttggcggtagaaaaagagatgcaaggtacgggtactgcccaagtcgaggtctttatctctggatctggtaaagctagagctgtaggttttatatgtattgcaaaatcatgtgatgagtatcccgatgattga

SEQ ID NO: 7773 - DNA, 639 bp, Methylobacterium sp. 4-46
atgatccgcgacctcctgccgcgcctgcgcggcgccccggcgagcgccgcgctgttcggcctcgtcttcctcgtgcaggcgctgcccgccgtgaccgtcgcggtcgagcagtcccggcggctgaccaccgggcggccggtcctgctcgccaccgccacccgcgatccgcgcgacctgttgcggggcgagtacagcgtgctgtcctacgagatcggccagcccgcgaacctgcccgccgccccggacctcgccgcgtcctgccccgcgcagggcgcgtgcccgctcgccgccggcaccaccgtgtacgtcacgctcgtgccgggggaggacggcctgtcccgcgccgcggccgtcgcggccgcaccgcccgcggacggcgccctcgccctgcgcggcacggtccggttcggcaccctggtgccgggcggctccgccgtctgtccggccgcgcgctgcctcgcgggcgcggtcacctacggcatcgagcgctggtacgggccgcagggcgcgcccgcggcgctcgaccgcctcgaccgcggccggatccgcatccgcgcccgggtcgatgccgcgggcggggccgtcctcgacgccgtcctggtcgacggccgggaggtggcgcgcaccccgcggctctga

SEQ ID NO: 7774 - DNA, 591 bp, Rhizobium leguminosarum bv  trifolii WSM2304
atgaactcgctgatggcaaggctgcactccggcaggggctatctgctttcggcaatcatcgtcgccggtctgcagaccgtgatcctcggcacgatcatccagagccgcgcctcgatcctcaacaacggcgccgaagtgctgctgaagacggcgcccgtcgatccgcgcgatttcctgcgcggcgattatgtcgtcttgaactatgacatttcctcggtgccggtgcagacggtctcaggcggcattccagccgagcccggcgagcgcacgctatgggttcgattgaagaagcaggaagacggtttctggacggtgatcgaatcgtcctttcgcgaactgccgccgctgccggagaccgtgatcctgcgcagccagcccttctacagtggcggccttgccgccggcgacagcatccgcgtcgaatacggcatcgagcgctattacgttcctgaaggtcagggcaagccgatcgaggaggccagaaacggcggcaatgtcgcaatcgccgtgcgcgtctcgccggcgggaagcgcgcagatccgcggtcttctcgttgacggcaagccggtttacgacgagccgctctactga

SEQ ID NO: 7775 - DNA, 636 bp, Methylobacterium nodulans ORS 2060
atgacccgcctcgccctccctcgtgccggcggcgccctggccgccgtggccttcgccctcctgttcgtcgtgcaggcggcccccgcggtgaaagtcgcgctcgaccagtcgaggcggctcgaagccggccgcgccgtgctcctcgcggctgccacccgagacccccgggatctgtttcgcggcgagtacagcgtgctgagctacgaggcgggtcagcccgcgggcctttcggcctccgaggatctcgcccgggcctgcgggccggagccgggatgccgtctgcccggcggcatgacggtctatgtcacgctcactgagggggcggacggcctgcaccatgccgcggcgatcgccgccaccaagcccaccgggaccaacccgttcctgcgcggcaccgtccggttcgggagcctgacccgcgacggtgggcgctcgccctgcgccggcctctgcttctccggcgctgtcgattacggcctggagcgctggtacgggccgcagggtgtgccggccgatctcgaccggctcgaccgcggccggatccgcatccgggcccgggtggatggcgaggggacggctatcctcgacgcactcctcgtcgacggccgcgaggtcgctcgcacgccgcggctctaa

SEQ ID NO: 7776 - DNA, 582 bp, Agrobacterium vitis S4
atgatgcagcgcaatcatatttttcgtctggtttccgcggcgattcttctggctgccctgcaaacggcggcgatcggctaccagattggcgagcgggccaatattttgcgcaacggccaggaggtcctgctgcggaccgaggcggtcgatccgcgcgatctgctgcgcggcgattttgtcgtgctgaattatccgatttcccgcattcctgaagagaagatcatcggtcctcgtccatcaagccgacaggatgtgcgtctgcatgtccgtgtcgtgccgcaggccgatggctttgccacggtcgaagaggcgtcggtcgccgatctgccggcaaagccgggaagcgtcgtgctgttaagcgaaccgctgtcctttccatcgcctctggcgcccggagacagtttgaccgtccattacgggatcgagcgattctatgtccctgaaggcgagggccgcgatatcgaggcacagcgtaatcaaggtgcggtttcaatcgccatacgggtgtctcatgcgggacgggcgcagatccggcaattgttcgttgcgggccagccggtttatcgggaaccggatttttga

SEQ ID NO: 7777 - DNA, 591 bp, Rhizobium leguminosarum bv  trifolii WSM1325
atgagctcgttcatggcaaggctgcaatccggcaagggctatctgctttcggcgatcatcgtcgccggtctgcagacccttatcctcggcacgatcatccagagccgggcgtcgatcctcagcgacggcgccgaggtgctgctgaagacggcgcccgtcgatccgcgcgatttcctgcgcggcgactatgtcgtcttgaactacgacatttcctcggtgccggtgcagacggtttccggcggcattccggccgaggccggcgagcgggtgttatgggtccggttgaagaagcaggaggacggtttctggacggtgaccgaatcgtcctttcacgagctgcctccgcagccggagaccgtgatcctgcgcagccagccattttatagtggcggacttgccgccggcgacagcatgcgtgtcgaatacggcatcgagcgttactacgttccagaaggccagggcaagccgatcgaggaggcccgcaatgacggcaatgtcgccatcgcagtgcgtgtctcgcctgatggaagcgcgcagatccgcagcctgctggttgacggcaagccggtttacgacgagccgctttactga

SEQ ID NO: 7778 - DNA, 402 bp, Dehalococcoides ethenogenes 195
gtgggtgacaagtggataggggtggctttgagcgaccccttgcggatactggcttcgcctttggttatcctccggcgtgacgatgatgcaaaaacagtggaaaacattgaagctttagtcaaaacccaccagccggatttgcttgttatcggcttgccggtatctctgaacgggactatcgggcctcaggcggaaaaggtaaaagccttcagcgggctgctctcacagagtttaaataccgaaattattttccgggatgaacgcttttccacagacgaagcccgccgcaaaatgaatgacagcggcaaaaacaataaaactgtccgggatgatgcggccgcggccgcagttattttgcaggattatctggacgagactaatccgccctgcttccagccttaa

SEQ ID NO: 7779 - DNA, 480 bp, Thermobifida fusca YX
gtgagaacaggagtgcggctcgctgtcgaccccggagccgcccggatcggggtggcccgcagcgatcccgacgggattctcgctatccccgtggagacaatccgccgcggaccgggagatctcgacagaattgccgcccttgtgcttgagtacgaagctcgggaagtcatcgttggctatccggcgtcactgtccggagccgaggggcgtgccgcccgcgcggcgcgcgcgttcgccaaagcgcttgcgcgcaggctcgccccggttccggtgcgactagtcgacgaacggctgaccacggtgaccgcggagctccacctgcgcacgggcgcttcataccgcaaacgcggggcccgtggcggcagagcccgccgatcggtcattgaccaggcggcagccactgtccttctccagaacgccctcgacaccgagcggcgtaccaagctgcctcccggtgaactcgtcgaggggacgccatga

SEQ ID NO: 7780 - DNA, 609 bp, Frankia CcI3
gtgagcggctcgggctcccggcccggggattctcggcccggggattctcggcccggggattctcggcccggggtgcggatcggggtcgatgtcggctcggtgcgggtcggggtcgccgcgagcgacccgggcggcgtgctcgcggttccggtgactaccctggccagggacagacggggtaatgcggacatagatcagctcgtcctcatcgtccgggagcggcaggctgtagaggtcgtggtcggcctgcccagacagatgtccgggcaggaaggccgggcggtccggctggtgcggcagtacgccgaggtactcgccgagcggatcgcacccgtccccgtgcgttttgtggacgagcggctcaccacggttgcggctcatcgcaggatggccgagcgtggcgttcgttcgcgtgcccgccggagtctcgtggatcaggaggcagccgtgcagatcctgcagcacgacctggacagccgccgggggagcgccgcgcccggcgtgatcgggtgtgccgccccggccgcgggtccggacggcgtggtccgggctccgagagacggcccccgggctccggacggtgttgtcccgccgtcggacgagaggtga

SEQ ID NO: 7781 - DNA, 510 bp, Mycobacterium MCS
gtgaccgacagcgaccaccgcctccccgatcgccccggagagggcgatccgggccgcggccggcggatcggcatcgacgtcggcagcgtgcgggtcggtgtggccaccagtgatccggacggcgtcctggccaccccggtggaaaccgtgcgccgcgagaagagctcggaccgtcacgtgcggcggttggcgcagctggtgaccgaactcgaggccgtcgaggtcgtcgtggggttaccgaggacgctggccgaccgcaccggaccggcggcccacgacgccatcgacgtcgccgaggcgttggcccggcggatcgcaccggttccggtgcggatggctgacgaacggctcaccacggtgtccgcgcagcgttcgctgcgcgaggcgggcgtccgcgccaaggggcagcgggccatgatcgaccaggtcgcggcggtgggaatcttgcagagctggctggaccagcggcgcgcggctctggccgcgcccggagagggcgggcatggctga

SEQ ID NO: 7782 - DNA, 420 bp, Rubrobacter xylanophilus DSM 9941
gtgagtccgcccgaggggagggtggccgcgctcgacttgggcgaggtctggacgggggtcgccgtctcggaccccacgaggaccctggcccggccgctggaggtggtcagaacctcggagctccccggcgttctgcgccgtctcgtccgcgaggagggggtcggggaggtcctggtcggcctcccgcgcacgctgcggggggaggtgggctttcaggcgcggcgggtgtcggatagactctcctcgctgagggccggcttcccggaggtccggtttgtggagtgggacgagcggctcaccacgaaggtggtctccgggccgctccgggaggggcggaggcgcggccgccgggagcgcgtggaccacctggccgccgcccggatgctgcaggagtacctcgagctgggagggggcgcttga

SEQ ID NO: 7783 - DNA, 600 bp, Arthrobacter FB24
gtgaaccaatctgttgaatccgacgcctacccccggggcatcaaactgggggtggacgtgggcacggtccgtgtaggcgtcgcggtgtgtgaccgcgacggcatcctggccacaccgttgaagacgctcgagcgaaacgccaagaaaaatacggatgtccgtgtgctggcgggtctggcatccgagcttggcgccgtgcaggtctttgtagggttgccgcgtacgctcaaaggggaagagcatgcttcggcccggatggcgacggattatgcggagctgctggccgaagccctcgcggcccgtggatcggacattccggtgcagctcgtggacgaacggttgagcacagtgacggcccaccgcaacctgcacgaagctggcatgagcagccggaatcaccgtaaggtagtggatcaggttgccgccgcaggaatactgcagcacgcaatcgacatgcaaaaagccaggggaacggatgtaggaagccgcgtgttcgcggtttcccagccggggctttccggggacgccgcagcggaaaacgctgatccggcagtcccgggaatcaatgtgcaatcttcagaaaatggaaggcaacagtga

SEQ ID NO: 7784 - DNA, 522 bp, Acidothermus cellulolyticus 11B
atgggcgacacagccgtgcgaccgggagtgcggatcggcgtcgacgtcggcacggtacggatcggtgtcgcggtcagcgatcccgacgggcggctcgccgtaccggccgagacactgccgcgtgacgcttccggagccggtgagctgcgccgccttgcccagctcgtcgaggagcgcggcgctgtcgaggttgtcgtcggcctgccggtctcgctccgcggtaccgcgggtgccgcagcccgggacattgccgggtacgcccgccggctggcgacagccgtgcacccggtgccggtccggctggtcgacgagcggttcaccacggtgcacgccgaccggcggctgcaatcggctggactcgccggccggcagcggcgggcggttgtggatcagcttgccgccgcgatcctcctgcaggacgcattggacgccgaacgcgccaccggccggccgcccggccggctggtcacccccgccgacccggacgacaccgccgcggctcggcgccgggaggcagggtga

SEQ ID NO: 7785 - DNA, 471 bp, Nocardioides JS614
atgagggccggcgtgcggatcggcatcgaccccggcgacgcccgcatcggggttgcccgcagcgacccgtcggggttcctcgccaccccggtggagacggtgcgtcgggggaagggcgacctcgcgaggatcggccggatccttgccgccgaggaggacgagggcgccaccgtcctggaggtggtcgtcgggctgccacgctcgctgtccggccgcgagggcccggcggcggccaaggtccgggagttcgccggccggctggcggcgcgggtcgcgccggtgccggtgcgcctggtcgacgagcgcatgaccacggtgtccgctgaggctatgctgcgcgaccagggccgcacggggggcaagcggcgagccgtcgtcgaccaggcagcagccgtcctgatcctgcagcacgcactggacaccgaacgcgcgacgggggccgcgccgggcgagatcgtcgaggagacgtag

SEQ ID NO: 7786 - DNA, 510 bp, Mycobacterium KMS; identical to SEQ ID NO: 7781

SEQ ID NO: 7787 - DNA, 528 bp, Mycobacterium vanbaalenii PYR-1
gtgcctgacaccgactggaccagccgcgtgcccgaccggccgggtgatccgaacacggctcccgaccctgggcgcggccgccgtctcggtgtcgacgtcggcaccgtccgcatcggggtggccgtcagtgatccggacgcgatcctggcgacaccggtcgagacggttccccgtgacaagcgtgggacgaagcatgtgcggcggctggctgcgctggtcgacgaataccaggtggtcgaagtggtggtcggcctgccccggactttggccgatcgcgccggttcgtcggcgcaggacgccacagaggtcgcggaggtgttggccggccgcatcgccccggtgccggtgcggctggcagatgagcggttcaccacggtgaccgcgcagcgtgcattacgggaggcgggagtacgtgcccgcggccaacgatcggtgatcgaccaggccgcggcggtggggatccttcagaactggctggaccagcggcgggcggcgctgcccgcacacggagaggtcttggatgactga

SEQ ID NO: 7788 - DNA, 510 bp, Mycobacterium JLS
gtgaccgacagcgaccaccgcctccccgatcgccccggagagggcgatccgggccgcggccggcggatcggcatcgacgtaggctgcgtgcgggtcggtgtggccaccagtgatccggacggcgtcctggccaccccggtggaaaccgtgcgccgcgagaagagctcggaccgtcacgtgcggcggttggcgcagctggtgaccgaactcgaggccgtcgaggtcgtcgtggggttaccgaggacgctggccgaccgcaccggaccggcggcccacgacgccatcgacgtcgccgaggcgttggcccggcggatcgcaccggttccggtgcggatggctgacgaacggctcaccacggtgtccgcgcagcgttcgctgcgcgaggcgggcgtccgcgccaaggggcagcgggccatgatcgaccaggtcgcggcggtgggaatcttgcagagctggctggaccagcggcgcgcggctctggccgcgcccggagagggcgggcatggctga

SEQ ID NO: 7789 - DNA, 528 bp, Mycobacterium gilvum PYR-GCK
gtgcccgacaccgactggaccagccgcgtccccgaccgtcccggtgatccgaacgcggccccggacccggggcgcggccgccggctcgggatcgacgtcggctcggtgcgcatcggtgtcgcggtcagcgatcccgacgcggtgttggccacgccggtggagacggtgacacgggaccgcaggtccggcaggcatctgcgtcggctgacgacgttggtgggggagtacgaggcggtcgaggtggtgatcgggttgccgcgcacactgggcaaccgggcgggatcctcggcgcaggacgccaccgaggtggccgaccagctggcggcgcggatcgcgccggtgccggtgcggctcgccgacgagcggttcaccacggtgacggcgcagcgggaattgcgggaggcgggagtacgggcccgtggccagaagtcgatgatcgaccaggccgcggcggtggggatccttcagaactggctggaccagcggcgagcagcgttgcccgcacacggagaggtcttggatgactga

SEQ ID NO: 7790 - DNA, 462 bp, Salinispora tropica CNB-440
gtggctgagtggtcccggggcgtacgcctcggggtggatgtcgggcaggtccgggtcggcgtggcccggtccgacccgcacggcgtcctggctacgccactggtcaccctggcccgggaccgtgccgtcgcgccggaggcggttcccagcgacatggccgagctggccgcgctggtgaccgaacacgaggcggtcgaggtggtggttggtctcccggtgaatctcgctggtcggcagggccccgccgccgtacatgtgcaggcgtatgtcggccgtctggtcgaggtgatttcgcctgtgccggtgacgctcgccgacgagcggatgtcgacggtggtggcaagccgtaggcttgccgagcgtggcgttcgggggcgccggcagcgggcggtggtggaccaggcggccgcggtggaaatcctgcagagctggctcgatgcgcagcggaggcggatgcaatga

SEQ ID NO: 7791 - DNA, 402 bp, Dehalococcoides BAV1
gtgggtgacaagtggataggggcggctttgagcgaccccttaaggatactggcttcccctttggttatacttcggcgtgacgatgataccaagacactggaaaatattgaaagtctggtcaaaacccatcagcctgatctgcttattatcggtctgcctatatctctaaatggtactatcggcccgcaggcggagaaggttaaaagtttcagtgaactactttcaaggcatttaaatatagaaattatttaccgggatgaacgcttttctaccgacgaagcccgccgcaaaatgaatgacagcggtaagaataataaaaccgtccgggatgatgcagcagcggcagcggttattctgcaggactatctggacgaaaccaatccgccttgttgccagccttaa

SEQ ID NO: 7792 - DNA, 513 bp, Mycobacterium tuberculosis F11
gtggtcccagcacagcaccgcccgcccgaccggcccggcgatccagcgcacgaccctggacggggacgacgcctcggtatcgacgtgggcgccgcgcgtatcggcgtggcttgcagcgacccggacgcgatcttggccaccccggtggaaacggtgcgccgcgatcgttccggcaagcacctgcgcaggctggctgcgctggccgccgagttggaggcggtcgaggtgatcgtcgggctcccgcgcacgctggccgaccgcatcggccgctcggcccaagacgcaatcgaactggccgaggcgctggcacgccgtgtttctcctacgccggtgcggctggccgacgagcggctcaccacggtcagtgctcaacgatctttgcggcaggcgggggtgcgggcctccgagcagcgtgcggtgatcgaccaagcggccgcagtggcaatactgcagagctggctggatgaacgtctcgcggcgatggccgggactcaagaaggctccgatgcctga

SEQ ID NO: 7793 - DNA, 567 bp, Frankia EAN1pec
gtgaccgctccggattccgcggctggcgcggattccgcggccggttcggattctgcggccggcgggcaggcggacgcggggcgcggcgtgcggatcggggtggatgtcgggtcggtgcgggtcggtgtggcggtgagcgatcctgacggtctgctcgccgtgccggtgacaactctgcgccgagatgtgtctcgccgtggctttgcggacgtcgacgagcttgccgacatcgttcgggacaggcacgctgtcgaagttgtcgtcggtctgccgcgtcacctctccggccgggagggcgaggccgtccggctcgcgcggcggtacgcggaggtgctgtccgcgcgtgtcgcgcccgtgccggtccgtctcgtcgacgagcggctgaccacggtcgtggcgcatcgcagaatggctgagcgcggactgcgttcccgggcccgccgtgatctcgtggatcaggaggcagcagtgcagatcctgcagcaccacctggacgtccgccgggcacgcgggggatccggcggcgccgcctcgggcggcactgggcggcccctggattcggcgtga

SEQ ID NO: 7794 - DNA, 462 bp, Salinispora arenicola CNS-205
gtggctgaatggtcccggggcgtacgcctcggggtggatgtcgggcaggtccgggtcggagtggcccggtccgatccgcacggcgtgctggccaccccgctggtcaccctcgcccgggaccgcgacgccgcaccggacgcggttcccagcgacatcgccgagctggccgcgctggtggccgagcacgaggcggtcgaggtggtggtcgggcttccggtcaatctcgccggcaggcatggtccagctgccgtacaggtgcaggagtacgtcggccggctggtcgaggtgatttcgcctgtgccggtgacgctcgccgacgagaggatgtccacggtggtggcaagtcgtaggcttgccgagcgtggcgtccgggggcggcggcaacgcgcggtggttgaccaggcagccgcggtggaaatcctgcagagctggctcgatgcgcagcggaggcggatgggatga

SEQ ID NO: 7795 - DNA, 459 bp, Bifidobacterium longum DJO10A
gtggtgtggttaggcgttgatttgggtaatgcccgggtcggactggcactgtccgacccggagcttacctttgcacatcctgctggcaacattcatgttgccggcgactatttctttgctattgacgaggtcctgaacgtcatcgaagacgaacatgtggaccatgtaatcgtcggactgcccctgcagatggacggtacagaaggcaaaagcgccaaaaaagcgcgcaggtgggcggccaatctggagaagaggctgcaagcagagagtgaagacagtgattctacggagtatcagattccgcaggtatcattgatagatgagagattgacaacagtcagtgcgcatcgtcagctgttcgaggcccataaagcttcgaacaagcacaggccggtggttgaccagcagtcggcagtggtgattttgcagacggcactcgaccgtacccgggagcagtga

SEQ ID NO: 7796 - DNA, 444 bp, Mycoplasma arthritidis 158L3 1
atgcgtaagctttgccttgatcttggcaaaaaaacttgcggttttgctattagtgatgttaaccaaactattgcaattggacttgaaaatttcttttatgaagagtatcatttttatgaagtaatcaatcgcattaaatactatcttgaagaaagcgaatttcaaggtcaagttgatgaaataatcttaggtttgcccttaagaatggacctctctgagagtaagacgacgaaaatggtcaaaaaatttgcaacggttttagccaaaaatatcactttgccaattcgtttgcaagatgaaaggcaaagcactaaaaatgccgaggcaattcttagccaaggcggatataacgcaaaacaaaaaaagctaaaaaaagactccttagcagcacaacttattttagaagattacttagaaaggcaacatcatgaaaaaagtaattaa

SEQ ID NO: 7797 - DNA, 444 bp, Ureaplasma urealyticum serovar 10 ATCC 33699
atgcgtaaattagcacttgatttaggaacaaaatcatgtggttttgcgattagtgatttattaggaataattgctagtggacttgataattttatctatgaagaaaatgattttatagctgttttagctaaaattgatgaaatcatgattaattatcatcatgaaattgacacaatcgttttaggttatccaactaatgtttatgatggatcaaaaaacaaacgaacatatttaatcgaatcattttatacattattaaaacaacactttttaaatcatgaaaaaattaaaattgtttatgaggatgaacgttttagtactaaaattgcaacacaacgtttaaaaaatagttgtgttaaagcagctaaaattaaaaaagttaaagataaaatgagtgctgttgttattttggaaagttatttaagtaaaaatcattttaattaa

SEQ ID NO: 7798 - DNA, 426 bp, Dictyoglomus turgidum DSM 6724
atgagagtccttgctattgattggggagaaaaatatatagggcttgctatatcggatcctttaaggataattgctcagggattagatgtttgggaaattaaagatgaagaagattttgtaaatagattaaaaaagttgataaaggaatacaatgttagtgaaatagtcttaggatatcctataagtctgagaggacatgaaaatgagaagacaaaaaaaatagagtatgttgcagagagaataaaaactgtcgtaaatctgcctataaaatttgtggatgaaagatttactactatggaggctgaaagagttcttttagagggtgacataaaaagaagagatcgaaaacttttgaaaaataaacaggcagcagtaataattttacagaagtatcttgattctttatctcttgacacaaaaatataa

SEQ ID NO: 7799 - DNA, 624 bp, Arthrobacter chlorophenolicus A6
atgccgtcgaacggcgccagtcctgacatggccgatcccgcaaccgccggcggctacccccagggcgtcaaactgggggtagacgttggcacggtccgggtgggggtggccatctgcgaccgtgactccatcttggccacgccgtacaagaccctggaccggaacaccaagaagaactccgacgttcgcctgatcgcgaaactggcggaggaactgggagctgtgcaggtcatcgtcggcatgccccgcaccatgaagggcgaggaacacgcttctgcgaggatggcgtccgactatgccggcctgctggcggccgaactcgcggcccgcggcctggacgtgccggtcaacatggttgacgagcggctcagcagcgtctcggcgcaccgcaacctgcatgaagctggcatgagcagcaggaaccaccgtaaagtagttgatcaggtcgcggcggcaggcatcctgcagcacgccatcgacatgcagaaagcccggggagcggatgtcggctcacgcgtgacagcgccatccccgtccgtggacctgggggacagcggtacggatgagtccgtccgcgccaccccggatacggcacgattttcagataatggaaggcaacagtga

SEQ ID NO: 7800 - DNA, 417 bp, Acidimicrobium ferrooxidans DSM 10331
gtgagcgaggggttcggcggccgcgctctcggcgtggaccttgggacgaagcgcatcggcgttgcggttgcagagggctcgctcgcgctgccgctcgaggtcatcgacgcgcgggggccgtggcgtgcgaggctcgccgagctggtcgcgtcggtcggtgcgagcgtcgtggtcgtcggtcttccgatcggcctcgatggatcggagggtcgggcggccgcccgggtgcgccagtggtcggaaggcctcgcggagcacctcgaggttccggtcgtgttcgtcgacgagcgcttgtcgtcgcaggccgccgagcgtcgtctcggggccgccggtgtcgacgccaggtcgcggcgcggtgcggtggacgcctttgccgcgaccgagatcctcgagcggtggctggtgacgcagcggtga

SEQ ID NO: 7801 - DNA, 513 bp, Actinosynnema mirum DSM 43827
ttgagcagcggtgacacccccggcgtcgacgatcccggcctcggcaggaggctgggcgtcgacgtcggggcggtccgggtcggggtcgcgctgagcgatccgggtgcctttctggcgaccccgctggttaccctgtcccgtgacgagaagaacggccgggacctggacgacctggtcggtctggcagccgagcacgacgtggtggaagtcgtggtcggcctgccccggaccctcgcgggcaagcacggaccggcggctcaggccgccacggcgtacgcggcggcgctcgccgagcgggtcgcacctctcccggtgcggctcaccgacgagcggctgaccaccgtgacggcgagccgcgtgctggctcagcggggggtgcggggcaagaagcaacgtgccgtcgttgaccaggctgccgctgtcgagatcctgcagtcctggctcgacgcacgagcgcgacacgtggcgagggccgcctccgagcggtcacctggagcgaaggacggctcgtga

SEQ ID NO: 7802 - DNA, 492 bp, Beutenbergia cavernae DSM 12333
gtgcgcctgggcgtggacgtgggaagcgtccgcgtcggtgtcgcgcgctgcgacccgagcggcgtgatcgcgaccccggtgacgacgctggcccggcgcggcaagcgtggcggggtcgcggagatcgcggggctcgtgcgtgaagattcggcgatcgaggtcgtgattggcctgcccagggcgttggacggtcacgaggggtcgtcagcacgtcaggcacgcgcgtacgctggacaggttgcccgcgccgtcgaaccggtgcccgtgcgactggtggacgagcggctgagcactgtcgccgcccatcgcgcgatgcacgaggccggccgtgcgggcagacgccaccgcgaggttgtcgaccaggcggcggctgtggtgatcctgcagtcggccctggacgcggagcgcgccaccggggcaccaccaggggagcacgtggttcccgcgcgcccggaaaccggggggacgatgacgaaggagggaagtccgtga

SEQ ID NO: 7803 - DNA, 546 bp, Brachybacterium faecium DSM 4810
atgagcgtggcggaggggacgggcgccgaggccggcgggctgcctcgaggggtccgcctcggggtcgacgtgggcgatgtccgcgtcggcctcgcccgcagcgacctcgacgggatgatcgccaccccggtcgagaccctcgagcgcggctccgccgtcgcgcgcgtcgtcgaggaggctcgcgagctcgaggcgcgtgtcatcatggtggggcttccgcggtcgctcaacggcgccgagggcgccgccgcgcagaaagcgcgcgatttcgctgcggagctcctgacctcgctggcctccgggccgacggagatcgaggtccgtatgatcgatgagcgcctgacgacggtgacggcgcatcaggcgctgcaccgctccggccgcaagggtcgcaagcaccgctcggtggtcgaccaggtcgccgcggtgatgatcctccagcaggcgctggacacggaacgggccaccggcgcacgcgcaggggagagggtcgaggccgccgcggccgagcaccccccggacccgaccgaggaggacgcccgatga

SEQ ID NO: 7804 - DNA, 570 bp, Micrococcus luteus NCTC 2665
atgcgctcgacgccgtcgtcgccgcggtgcgcgcggcctgaggcggacgtgagcgcaggtcaggacggggccaacgcggcaaccgacgccgtgcgccgggggcgcaccctcggcgtcgacgtcggccgtgcccgcgtgggcgtcgcgtcggccgaccccgacggcctgatcgccacccccgtggccaccctgcggcgggatgcgcgtcgacgtcgtgacgtggacgagctcgtcgcccacgcacgcgagctcgacgtcgtcgccgtgtacgtcggcctgccggtgaatctgcggggcgagcacacgccgtccacgcaggacgccctcgactacgcggacgccgtcgccgccgccctggccgaggcgggccaccccgtgccgctccggctcgtcgacgagcggctcagcacggtctccgcgcaggccggactgcgggccgcgggccggtccgtcaaggacagccgcggcgtgatcgaccaggcggccgccgtcgcgatcctgcaggccgccgtggacgagcagcgccgcaccgggcgctgggccggccaggaccgggagccgatccggtga

SEQ ID NO: 7805 - DNA, 486 bp, Kytococcus sedentarius DSM 20547
gtggtctgggccgtggacgtgggcctggcccgcgtcggggtggccagcggcgaccccgacggtgtcctggcgaccccggtggagaccgtcgcggtggccccgggtcttaccgccctcgaccgggtggtccagctcgtccgccaggaggagcgctccacgggcgtcgtggtgggcctgccccgccacctcgacgggcacgaaagcacctcggccgtcgaggcgcgccgctgggccacggctctggcgtcccggctgggccccacggtccgggtctggctggtcgacgagcgcctgagcaccgtggccgcctcgcgcggcatgcgggaggctggtgttcgtgcgaaagagcagcgcacccgcatcgaccaggccgccgcggtcgagatcctgcagatgtccctcgatgcatggcgtcggggctctagaatcggcgagctggtccccggtcgcaagccgcgcagtcgagcggccggcaggactccgtga

SEQ ID NO: 7806 - DNA, 417 bp, Eggerthella lenta DSM 2243
atgcgaattatggctttggatattggggagacgcgcgtgggggttgcggtgagcgatccgggggagcgggtggcttctccggtggccgtgctgcccgcctcggaagtgctgaactgcgcgaagccgttccagcgagcgcttgaggattgggagccggagctgctgctgtgcggacttccctacaccatggcgggcgcggaggggcctcaggccgcgcgcattcggaaagcggcgaaaaccatatccgacgcctgcggcatcccttacgaattcgctgatgagcggttaagttcgcaggaagccaaacggagtttgcgtgaaaagggcatgaccgagaaggccatgcgcggcaaaatagatatgatagccgcaagtttgtttttgcaggcgtggcttgacgcgcgccgtgaggcttga

SEQ ID NO: 7807 - DNA, 516 bp, Catenulispora acidiphila DSM 44928
atggaacagccggaggtcccggatccgtccccgcgaagcgagatgcgccgcggtgtgcgcctcggcgtcgacgtcggcaccgtccggatcggcgtcgcctcctgcgaccgcgacggcttgctcgcgaccccggtggagacggtgaaagccgagccgcgccgcgcctccctggaccggctggccgcgctggccgccgagtacgaggccttcgagatcgtggtcggcctgccgcgctccctgtccggcggcgagggtccggccgcggccaagatccgcgcctacgcgcgcgatctggtgcgccgcctgggtcccgggacgccggtccggctcgtcgacgagcgtctgtcgacggtcaccgcgacccagggtctgcgcgcatccggggtcaaagccaagaaaggcagatcggtggtagaccaggctgccgccgtggttatcttgcagaacgcacttgatgccgaacggatgtccggacgtccgcccggcctgatggtccagctggaggacggcaactga

SEQ ID NO: 7808 - DNA, 423 bp, Cryptobacterium curtum DSM 15641
atgcgggtactttcactcgacatcggtcaggtgcgctgcggtatcgcaataagcgatccgactggtcgagtggcaagtccggtctgtgtactgccctctggtgaggtcattggttgtgctcgttcattcaaacggctgctcgacgactggcagcccgacctgttattagcgggtctgcccttaacactttctggttcttctggtgggcaagcgcagcgtatacgggcgcaggcacagcagattgccgatacaagtgggctgccccttgagtttgttgacgaacgtctcagttcgcaagaggcaaaacgtatgctacgcgaagaaggcctgaccgagcgcgatatgcgcggaaagatcgatatgattgccgcaagtatttttctgcaagcttggcttgaccgacaacgcgccaagaagcgctga

SEQ ID NO: 7809 - DNA, 465 bp, Saccharomonospora viridis DSM 43017
gtgaacgatcccgggcccggtcggcgcctcgccgtcgacgtggggtcggttcgagtcggggtcgcgctgagcgatcccacgccgatcctggcgtccccactcgttaccctgtcgcgtgatgccgacaccgacaaggatctcgaggagttggcccgactcgtcgccgaacacgacgtggtcgaggtgatcgtgggacttccgaggacactggccgaccgtcatggcaccgccgccgccatcgccgcggactacgcgcggcgactggctgagcggatctcacctgtcgcggtgcgattggccgacgaaagactgagcacggtgagtgcgagccgtatgctctctcagcgtggtgtgaagggacggaagcagcgggctgtggtcgaccaggctgccgcggtggaattcctgcaggcctggttggatgcgcgcgctgccgctgtcgcacgggaggcaggacagcagtga

SEQ ID NO: 7810 - DNA, 504 bp, Jonesia denitrificans DSM 20603
gtgcgtgagtttggtcgtggtgtcaggcttggggttgatgtggggcaggttcgtgttggggttgctgcgtgtgaccctgacacgatcttggccactcctgttgagactcttgcccgagaccggtctgtcagttatgtcgctggcgggaaggttccttcggtgcttcccacagacattgaggatttacgggagattgctgaggaacgactagctgtagctgtctatgtggggcttcccaagcatctgtctggtgcgcgaggcgtgtccgctgagatggccgtgaattacgcctcacttgtgcagcgtgtgttacctcaccttgaggtgcgtcttgttgatgagcgactcacgtcaaaaacagcccattcggctctccatgatgcaggtcgccgcgcccgtgagcaccgcactgttattgaccaggcggctgccgttgtcatccttgatacagcgcttgaggctgagaaacgactcgggtcttgggcgggagaatctgtggagtag

SEQ ID NO: 7811 - DNA, 417 bp, Slackia heliotrinireducens DSM 20476
gtgcgcgtactagcgcttgacatcggcgaggtccgcatcggcctcgccgtttccgatgcggcggggcgcatagcttcgccgctcaaggtccttcccgccgacgtagtgctcaacgacgggcgcgaattccgtatgctcgtcgaggattgggagatagaacatctggtgtgcggcctgccgtatacgatggcaggggaggaaggccctcaggccgcatccatcaaagagaaggcgcgacaaatagccagtgcacgcgacctgcccttatccttcgttgacgaacggctgagttcggctgaggcgaaacgcattttgcgtgaagagggcttggatgagcggagcatgcgcggtaaagtagatatgattgcagcaagcctgtttttgcaggcttggctcgattcgcatgacgaccagtaa

SEQ ID NO: 7812 - DNA, 423 bp, Atopobium parvulum DSM 20469
ttgcgtgttttagctttagatattggtgaagttcgcatcggggttgctgtaagtgaccccgatggtgctattgcgtcacctgtttgtgtacttcctgcacaagaggtgctctcgcatgcgcgcacgtttaaaaccgtgcttgaagattgggaaccagagcttcttttgtgcggtcgtcctaagacgctcgccggtgaagatggcccacaggcccaaaaaattaccgttcaagctgagcaaattgcgaagaactgccaacttccattagaatttactgatgaaagactctcttccgcggaagcgaagaagattcttcgagcgcaaggtttatctgagaaagctatgcgtgggaaagttgacatggttgctgcttcgctctttttgcaatcgtggcttgatgcacagatgaataagggagactaa

SEQ ID NO: 7813 - DNA, 510 bp, Nakamurella multipartita DSM 44233
atgactggaacacagcagaatccgtccggtgacgcacccgcgaaaggcgtgcgtctgggggtcgacgtgggtaccgttcgcgtgggggtcgcacgcagcgatcccgcaggaattctggcgactccggtgacgaccctgcagcggtcggcggccccgtcatcggggaagtcgggtgaccgggccgaaccgactgcggatctgtcggcactgcgtgacctggtcgtcgaacacgacgtagtggaagtggtggtgggtctgcccaccaccctgcgcggcatggagggctcggcggtgacggcagcgcgggcctacggacaggcactggcggcattgatcgccccggtaccggtcgtctacgtcgacgagcggctgaccaccgtcaccgcggaccgggtgctcgcccaggccggaatcaagggaaaggccaggcgcgccgtggtcgatcaggtcgccgccacccggatcctgcagaaccggttggatctgctggcggcgggacgacgatcgtga

SEQ ID NO: 7814 - DNA, 267 bp, Brucella suis 1330
atgaaatcgatggaatatgcaccggcagatctggatgaaatgatcgcacgcgaaaagaagcttgtggccattgaatatcagaatgaagcctgggctgacggtatgtccgaaggaatcgaaccggaaatccttgctgaagccgccttcacgacggccctgaccgaacttatccgtgaggttggcgacgattgcgcgctcgacctcattgaaaaaatgcgcgaacaggtgattgcaggtacattcctgtcccggcgtattcttcagtag

SEQ ID NO: 7815 - DNA, 258 bp, Mesorhizobium BNC1
atgcatatgactgttgccgatatcgaagcgctgatcgaggaagaaaagcgcacgacctgtgctgaatgccacagtgctgcctgggccgaggggcttctggcgggcatagaaccggagattatcgcggaggccgcgcttgccaccgcgctcggagagttggggaaaagcggagaagaagaaaagcttctcgaactgctcgacaccatgcgccggcgagtgctcctgggtgatttcctgccgcaacagagccgccattga

SEQ ID NO: 7816 - DNA, 270 bp, Sinorhizobium medicae WSM419
atggaacgaatgatggaaccaagcctgacagacatcgacgacatgatcgtccacgagaagatgcaggcggcactcgagcaccagaacgaggcctgggcggatggcatggccgacggcatcgagcccgaaatcatcgccgatgcggcgattgcgctggccatgcgcgaaaccgtccggctgcatggcgaagaaggtgccgaggcaatgctgaattcgcttcgtgagcgcatgctcgccggagaattctcccccgagcggacaattcagtaa

SEQ ID NO: 7817 - DNA, 258 bp, Ochrobactrum anthropi ATCC 49188
atggaacatgcaccggccgatctggacgaaatgattgcgcgcgagaagaaactcgtcgcaatcgaatatcataacgaggcctgggcagacggtatctctgaaggtatcgaaccggaaatccttgccgaagcagcctttacgaccgcgcttactgaactgatccgtgaagcgggcgacgattgtgcgctggagctgattgagaaaatgcgcgaacagattgtagcgggaaccttcctgccgcagcgcattcttcaatag

SEQ ID NO: 7818 - DNA, 258 bp, Rhizobium leguminosarum bv  trifolii WSM2304
atggaagcaagcctcaacgagatcgacgacatgatcgtccacgagaagatgcaggcggctctggagtaccagaacgaggcttgggccgatggcatggccgacggaatcgagcctgagatcatcgctgatgccgctattgcgcatgccctgcgcgagacgatcagattgcacggggaaagcagcgccgaagccttgctggattcgctgcgtgaacgcatgcttgccggcgaattctccgcgaaccgcaccctgcaataa

SEQ ID NO: 7819 - DNA, 258 bp, Agrobacterium vitis S4
atggaaccacgccgcaacgagattgacgacatgatcgttcatgaaaagatgcaggctgccctcgaatatcagaacgaggcatgggccgatggcatggctgacggtatcgaaccggaaatcattgccgatgcggccattgcactggccatgcgcgaaaccatccgcattcatggtgaagatggtgcggaagccatgttggagtctttgcgtgcccgcatgctggccggtgagttttctcccaagcgaagtgttcagtaa

SEQ ID NO: 7820 - DNA, 258 bp, Rhizobium leguminosarum bv  trifolii WSM1325
atggaagcaagcctcaacgacatcgacgacatgatcgtccacgaaaagatgcaggcagctctggagtaccagaacgaggcttgggccgacggcatggccgacgggatcgagcctgaaatcatcgctgatgccgccattgcacatgcgctgcgcgagacgatcagattgcatggggaaaagagcgccgaagccctgctggattcgctgcgtgagcgcatgcttgccggcgatttctccgcgaaccgcaccctgcaataa

SEQ ID NO: 7821 - DNA, 294 bp, Ralstonia eutropha JMP134
atgagaaccaagaaaggacggcgccggactcccgacagccgcctcaacatcgaaatggagacagacatgctcaagctgttcataggcttgggaatcccgtacatcggcgtgatcggcatgctgccgtgggtagcgtcggtcgagcgcttcgtgctcggggtgcccttcatctatgcgtggattttcctgtggtttgtgctgacgtcgggctgcatgctcgcgtgctggtggttgttcgaccgacgcgccgattcgcttgacaccgaggtcgtgcccgcggccgacccctgctga

SEQ ID NO: 7822 - DNA, 210 bp, Burkholderia 383
atgcccaagtttctgatcggcatcgccgtgccttatctcggcgtattgggtttgctgccctgggtctcgtccgtcgatgcgtacgtgttcggcgtgccgttcatctacgcgtggatgttcgcgtggtttgtgctgacgtccgcatgcctgtacgtctgctggcgctgtttcgacaagccggcggccgatgcggcgcggcttgatgtctga

SEQ ID NO: 7823 - DNA, 198 bp, Burkholderia 383
atgctcaggtatctgatcggcatcggtattccgtatctcggcgtgatcggcgtgctgccctgggtggccgcgcaggaccgctacgtgctgggcgtgccgttcatcttcatgtggatcttcgcgtggttcgtgctgacgtccggctgcctgttcgcgtgctggatgctgttcgaccgccgcgcgagcggtgccgcgtag

SEQ ID NO: 7824 - DNA, 210 bp, Cupriavidus metallidurans CH34 uid250
atgctcaagctactgatcggcatcggcattccctacgttggcgtgctggggctgctgccctgggttgcgtcggtggacaccttcgtgctcggcgtgccattcgtctatgcgtggatgttcgcctggttcgtgctgacgtcggtgtgcctctacgtctgctggcgtttcttcgaccgtcctgtcgacgccgagcgtcggctggacgcctga

SEQ ID NO: 7825 - DNA, 207 bp, Delftia acidovorans SPH-1
atgctcaagctgttcatcggcataggcatcccgtacatcgcggtgatcggcctgcttccctgggtcgcgtccgtcgatcgccatctgctcggcgtgcccttcatctacctgtggatcttcatgtggttcgtgctgacgtcgctgtgcatgctcgtgtgctggctgatgttcgaccgccacgaagccgacgacgtgcagtcggcctga

SEQ ID NO: 7826 - DNA, 195 bp, Burkholderia multivorans ATCC 17616 JGI
atgctccgatatctgatcggcatcggtattccgtatctcggtgtgatgggcgtgctgccgtgggtcgcgtcgcaggaccgctacgtgttcggcgtgccgttcctgttcatgtggatcttcgcgtggttcgtgctgacgtccggctgcctgttcgcgtgctggatgctgttcgaccgccacacgcccggcgcgtag

SEQ ID NO: 7827 - DNA, 210 bp, Burkholderia phytofirmans PsJN
gtgctcaaactgtttatcggactcggcattccctatcttggcgtggtcggcctgctgccgtgggtggcgtccgtcgatcgcttcgtgctgggcgtgccgttcatctatgcctggatcttcgcgtggttcatcctcacctccgggtgcctgatgatctgctggcgcgtgttcgactgccgccacgacgagtcccacccgcaaaacagctaa

SEQ ID NO: 7828 - DNA, 267 bp, Gluconacetobacter diazotrophicus PAl 5 JGI
atgatcgatgatccgcccgcggatgccgcacccgtcatcctgccgaacggaccgtcgcccgtgctgccgcgatggcggctggccgtcgggatcggtatcccgttctgcgccgtggatctggctctgccgtggctggaccgggtgcggggcacgatcctgggcttcccggtcgtgacggcctggctgttcgcgtggttcgtcctgacctccgcctgcctgggcacggtatgggtcctgcatgaccgccatctcggcgatgacgactga

SEQ ID NO: 7829 - DNA, 525 bp, Rhodoferax ferrireducens T118
atgacactcattcgccccagccaaactgaagacatcccggccatcgccgccatttatgcccgccatgtgctgcacggcaccggcacctttgagattgatcccccctcgccagacgacatggcgcagcgccgcgttgacgtcctggccaagggtctgccgtatctggttgctgcaaaaggcgatcaggtgatgggttttgcctactgcaactggttcaagccacgcccggcctatcgattctcggccgaggactcgatctacctggccgatgaagccatcggacagggccttggacgcgcgttgctggcggaactgatggcccaggccgaaaaagcaggcgtacgaaaattgatcgcggtcatcggcgactcagccaaccacggatcgatcggcgtgcaccggtctgccgggttttccatggtcggcgtgctcaaatcatgcggctggaaatttgatcagtggctcgatgtggtcatgatggacaaagccttgggtctgggcgctacccgcgccccgcaaacataa

SEQ ID NO: 7830 - DNA, 537 bp, Polaromonas JS666
atgcctctcatacgccccagccgcgacgaagatcttcccgccatcaccgccatttacggccatcatgtgctccacggcacaggcacctttgaaaccgagccacccagtttggccgacatgacggcccggcgggccgatgtgctgtccaagggcctgccttacctggtcgccgaggaggacggcagaatcgccggttttgcctacggcaactggttcaagccgcggccggcctaccggtattcggtggaggactcgatttacctggcacccgacctgcaccgcaagggcctgggccgcgcactgctcaccgcactgctggcacactgcgaagctgtgggcattcgcaaaatgatggccattattggagactcggccaatgccgggtccgtcggcgtccatctcgcgctgggcttcacgcaagttggcatcgtcgagtcctgcgggtggaaattcggcgcctggcgcgacatcgtcatcatgcaaaagaccctgggcgtgggcgacacgcaaccgcctaccgaactgcccgctccataa

SEQ ID NO: 7831 - DNA, 594 bp, Acidovorax avenae citrulli AAC00-1
ttgagacacgcgacatggccacccggccagcgacacgctgcaaagcccgcgattatatccacatcccgacgtatgcccaatatccgcccgagccgcgacgaagatcttcccgccatcaccgccatctatgcccaccatgtgctgcacggcacgggcaccttcgagaccgatccgcccagcgccaccgacatggcggcgcggcgggcggacgtgctggcgcgcggcctgccctatctggtggccgaggaacaggaagaaatcctcgggttcgcctacgccaactggttcaagccgcgcccggcctaccgcttttccgcggaagactcgatctacgtggcggacgcggcccgtgggcgcggcgtgggccggctgctgctggatgccctgtgcggcgctgccgaggccgcgggcgtgcgcaagctgctggcggtgatcggcgactccgccaacgccggctcggtcggcgtgcaccgcgccgccggcttcaccgaaatcggggtgatgcgctcggtcggctggaagttcggtgcgtggcgcgacgtggtgctcatggaaaagcccctcggcgccgcggacaccacggcacccgaatga

SEQ ID NO: 7832 - DNA, 522 bp, Acidovorax sp. JS42
atgcccctcatccgcgccagccgggacgaagacgtcgccgccatcaccgccatctacacccaccatgtgctgcacggcacgggcaccttcgagatcgacccgcccacggcgctggacatggcggcgcggcgcgcggatgtgctggccaagggcctgccctacctggtggctgaagaagcaggccaggtcctgggctttgcctactgcaactggttcaagccccgccctgcctaccgtttctcggccgaggattcgatctacatcgccgatgcggcgcgcggccggggcctgggacggcagttgctggaggccctcgccgtgcaggcagaggccgccggcgtgcgcaaactcctggcggtgatcggcgactcggccaatgcgggttccatcggcgtgcaccgggccgcaggtttcaccgacgtgggcgtgatgcgctccgtgggctggaagttcggcgcctggcgcgacatcgtgctcatggaaaagcccctgggcgcgggcgataccaccgcccccgaatga

SEQ ID NO: 7833 - DNA, 537 bp, Polaromonas naphthalenivorans CJ2
atgcccctcatacgccccagccgcgacgaagacattcgcgccatcaccgcgatttacgcccaccatgtgctgcacggcaccggcacgtttgaaaccgagccgcccggaaccagcgacatggctgcccgccgtgccgacgtgcagtccaagggactgccctacctggttgccgagcaggacggaaagattctgggctttgcctacggcaactggttcaagccccgtccagcctaccggtattcggtggaggactcgatttaccttgcgccggacctgcagcgcaagggcctgggccgcgccttgctggctgaactgctggcgcgctgcgaggcggcggggattcgcaaggtcatggccatcgtcggcgattcggccaacgccgggtcggtgggggttcacctggccctgggtttcaggcaggtcggcatcattgagtcctgcggctggaaattcggcgcctggcgcgatatcgtgatcatgcaaaagaccctggggcctggcgacacggagccgccgtcagaaccgtccgcctcataa

SEQ ID NO: 7834 - DNA, 546 bp, Verminephrobacter eiseniae EF01-2
atgaccaccatcatccgccccggcgccgacgacgacatccccgcagtgacggccatttaccggcaccatgtgctccacggcacgggcacgttcgagttggatcctccttgcgcgaccgagatggccgcccgtcgcgccgacgtgctggcgcgtggcctgccctggctggtggcgcaggaagacggccagatcctgggctttgcctatgccaactggttcaagccgcgcccggcctaccgtttctcggccgaggactcggtgtatgtggccgacagcgcccgtggccgggggctgggccgccaactgctggcagaactggtggcgcaggctcaggccgcaggcgtgcgcaagctgctggccgtcatcggcgactcggcgaacgcaggctcgatcggcctgcaccgggcgctgggctttaccgatgtcggcaccatgcgctccgtgggctggaagtttggcgcctggcgcgacatcgtgctgatggaaaaacccctgggcgccggtgacagcaccgcgccggaaggcgatggcgcagcgcctggatga

SEQ ID NO: 7835 - DNA, 573 bp, Methylibium petroleiphilum PM1
atgagtgccacctaccctgccgctgcgctcctgctgcggcccagcgccgccgccgacctgccggccctcaccgccctctatggctggcatgcccggcatggcagcggcaccttcgagctggagggcccgagcctcgaggagatggcccggcgccgagacgacgtgctcgccaagggcttgccctggctggtggccgaacgccacggcgacctgctcggctatgcctacgcagcgcctttccgcccgcgcctggcttaccggttcgcactcgaggactcgatctacctggccccgcacgcacaccgccagggtgtgggccgggcgctgctggcggagctgatcgcccgctgcgaggcctggggcgcgaggcaaatgttcgccgtgatcggcgacagcaccaatgccgcgtcgatcggcctgcaccgcgcgctcggcttcgccgatgtgggcacgatgcacgcggccggctggaagttcgaccgttggctcgacgtggtcatcatgcagcgcaggctcggcgacggcgatgccacgccgccttcggattgccccccggcaggaggccgttcatga

SEQ ID NO: 7836 - DNA, 525 bp, Delftia acidovorans SPH-1
atgcctaccattcgctcaagcctggacggcgatctcgccgccatcacctccatttaccgccaccacgtgctgcacggcacgggcacgttcgagaccgatccccctgccgaatcggacatggcaacgcgccgcgcggacgtgctggccaagggcctgccctatctggtcgccgtggacgaacagggccaggtgctgggcttcgcctatgccaactggttcaagccgcgcccggcctatcgcttctccgccgaggattccatctacgtgcatgacgcggcgcgcggccagggcttgggccgcctgctgctcgatgcgctgtcgcgcgaatgcgaggcggccggcgtgcgcaagctgctggcggtgatcggtgactcggccaatgccggctccatcggcgtgcaccgcgccgcaggcttcaccccggcgggcacgctgagctccatgggatggaagttcggccgctggctggacatcgttctcatggagaagaccctgggagacggcaaccgcagttcgcccgaataa

SEQ ID NO: 7837 - DNA, 561 bp, Leptothrix cholodnii SP 6
atggcctcctttctgatccggcccggcgtcgctgccgacctgccggccatcaccgacatctacgcctggaacgtcgaacacggcaccggcaccttcgagctcgaggcgccctcgcaagccgagatggcgcaccgtcgcgacgacgtgctgtccaaggggctgccctggctggtggcgcagcgcggcgaccaggtgctggggtatgcctacgccaatcacttccgcccgcgcccggcgttccgtttcgcgctcgaggactcggtctatctcgcccccgcagcacagggccaggggctcggcacgctgctgctggccgaactgctggcgcgctgcacggcgatcggtgcgcggcagatgttcgcggtgatcggcgactcggccaatgccggctcgatcggcgtgcatcggcgctgcgggttcgccgaagtgggcgtgatgcgcgcggcgggctggaagttcgatcgctggctcgacgtggtgatcatgcaacgcagcctgggcctcggcaaccagggcagcccgcaggactacggaccggccgctgccggagtcgccgcatga

SEQ ID NO: 7838 - DNA, 522 bp, Diaphorobacter TPSY uid29975
atgcccctcatccgcgccagccgggacaaagacgtcgccgccatcaccgccatctacacccaccacgtgctgcacggcacgggcaccttcgagatcgacccgcccacggcgcaggacatggcggcgcgtcgcgcggatgtgctggccaagggcctgccctatctggtggccgaagaagcaggccaggtcctgggctttgcctactgcaactggttcaagccccgccctgcctaccgtttctcagccgaggattcgatctatgtcgccgacgcggcgcgcggccggggcctgggacggcagttgctggaggccctcgccatgcaggccgaggccgccggcgtacgcaagctgctggcagtgatcggcgactcggccaatgcgggctccatcggcgtgcaccgggccgcaggtttcaccgatgtgggcgtgatgcgctccgtgggctggaagttcggcgcctggcgcgacatcgtgctcatggaaaagcccctgggcgcgggcgataccaccgcccccgaatga

SEQ ID NO: 7839 - DNA, 525 bp, Variovorax paradoxus S110
atgaccctcaccatccgccccagccgcgaccaagacatcgcggccatcacggccatctacgcccaccacgtgctgaccggcaccggcaccttcgagaccgaagccccctccgccgccgacatggccgcgcggcgcgccgacgtgctcggcaagaacctgccctacctcgtggccgaagaagatggcgaagtgttgggttttgcctactgcaactggttcaagccgcgcccggcctaccgcttttcggccgaagactcgatctacatgtccgaagccgcacgcggcaagggcctgggcgcccagctgctggccgccctctcgcaggccgccgaagcggtgggcgtgcgcaagctgatcgccgtcatcggcgattcggccaatgccggctcggtcggcgtgcaccgcagccagggcttcacgcacgtgggcgtgctcaaggactgcggctggaagttcggccaatggcgcgacgtggtcctgatggaaaaggtgctcggcgaaggcagcaccacccaacccgaatga

SEQ ID NO: 7840 - DNA, 276 bp, Dehalococcoides ethenogenes 195
atggaaaaagttacgggtaaaaatgccggggagattaaactttatgctctcagcacctgcggctggtgccgcctgacccgccagcttctggctgaactgggagtggcttatgaatttgaatatgttgatttgcttaccgggtctgagagggataaagcggtaacagagcttagcgcccttaacccgtcaaaatcttttcccactatgctgatagggggaagcaaagtgataataggctataaggaagccgaaatacgggaggctctgaaagcatga

SEQ ID NO: 7841 - DNA, 312 bp, Methanosarcina barkeri fusaro
atggatgtatctactctgaataaagaaaaaggagatcacatttctggaattgataggggtaaggttgtaatgtatgggcttagcacctgtgtatggtgtaaaaggaccaaaaaactgcttaccgatcttggtgtggacttcgattttatatacgtggataggcttgaaggaaaagaagaaaaccaggctgttgaggaagtaaggcacttcaatccttcaacttctttcccgacaactgttataaatggggaaaaagcgatcgtgggttttaaagaaaaagaaatccgtgaagcccttggatttcaaggataa

SEQ ID NO: 7842 - DNA, 360 bp, Desulfovibrio desulfuricans G20
atgggaacgcaggcactgccgtgtgcctgcattgtcatctgttccggccgctgctatgttgccggtgatatcaaccctctcagaaaaggaagcaccatggcggaaaacagcgacgtgcgactgtatgccctgtccacctgcatccattgcagaaaatgcaaggaatttcttgaagagcattccgtgccctttgagtgcgtctatgtggacatgctgtccggcgatgaacgcagtgagaccatttcgttcatcaaaaaacacaatcccaaactttcgtttcccacgctggtcatagacaacggcggcacggtgattgtgggctttcacaaagatcagatcgaggaggctctggacttatga

SEQ ID NO: 7843 - DNA, 240 bp, Methanospirillum hungatei JF-1
atgttgtatgccctttctacctgtattcattgtaaacagaccagaaaacttcttgatgaattaaaagtagcctatgattacctgtatgttgatcaactcagtcgaagcgagatggatgaggtactcaaagagatggagaaagtaaatccacggggatcatttccgactttggtaatcaataataacaaggttattgtgggaagcaggcttgatgagatacgagaggcgcttttgtcatga

SEQ ID NO: 7844 - DNA, 282 bp, Methanosaeta thermophila PT
atgggaaaggtacatgtcgatgggcacgatgctggtgctgtgacactttatgcgttgagcacatgcatgtggtgcaagaagacgagggatcttctctcgaagctcggcgtgagctacgattatgtttacgtggatctgacgagtggcgctgagagagcggagctaattgatgagctcaggaaattcaacccggatctcacttttccgacgctcgttgcaaatggcagggttatcattggattcaaagagaaggagataatgagcgcgctgggggcattatag

SEQ ID NO: 7845 - DNA, 246 bp, Syntrophobacter fumaroxidans MPOB
atggcggattgtgatgtcatgctctacgcgctcagcacctgcattcactgcaaaaacaccaaggaatacctggacggttgcggggtcaaatacgactgtgtcgaagtggacaagcttgaaggcgatgaaaggaagaacatcatcgaggaaatcaagaaggtgaatcccagttgttcctttcccacgatcatcatcggggacaagatcatcgtcggttcaggaaggaagaaatcaaggaggctctga

SEQ ID NO: 7846 - DNA, 258 bp, Desulfovibrio vulgaris DP4
atgtcaggttgcagcgtcaagcttttcgcactctccacctgtgtgcactgcaagaacacgcggcgttttcttgaagaccacaaggtggatgtcgattgcatctatgtggacaccctgcagggtgaagagcgcaagcaggtggtggaagaggtgaagaagcataaccccaagctgtcgttccccactgtggtatgcgcaaacggcaaggtgattgtcggctaccgcgaagatgaactgaaggaggctctttcgttatga

SEQ ID NO: 7847 - DNA, 288 bp, Methanoculleus marisnigri JR1
atgcagcgcgtgcctggagtcgaccgcggcagagtggtgctttacgccctgagcacctgcggttggtgtgctcggacgaaggaacttctcaccgacctcggcgtcgggttctcgtacgtctacgtggatctgcttgcgggggaggagcgcgatcatgtggtcagggaggtcgaacgctggaacccccaggtctcgtttccgacggtcgtcatcgacgaggcgaaggtgatcgtggggttcagggaagaggagatccgggaggcggtcggtgcccggcacagtgagtga

SEQ ID NO: 7848 - DNA, 276 bp, Dehalococcoides BAV1
atggaaaagattataggcaggaatgcaggtaagattaaactatatgccctaagtacctgcggctggtgccgtttgacccgccagcttctggctgaactgggagtagcctacgaatttgaatatgttgatttgcttaccggagcggaacgggaaaaagccgtaaaagaactgacggctcttaacccgtccagctcttttcctacgatggttatcggggaaaacagagtgataataggttataaagaatctgaaatacgggaggcgctgaaagcatga

SEQ ID NO: 7849 - DNA, 279 bp, Candidatus Methanoregula boonei 6A8
ttgccgacgcacgtaaacggtaaaaaccggggatctgtcatgctgtatgccctctcgacctgccagtggtgccacaagaccaaggtcctgctggaggaactgggcattgcctttgattacgagtacgttgatctgctcgaaggcggggagcaggacagggtgatgaacgcggtggagcactggaaccccagcggatcgtttcccacgctcgtaatcgacaataaacgcgccgttgtcggtttccgcgagcatgagatccgggaggccctcgcggtatga

SEQ ID NO: 7850 - DNA, 258 bp, Candidatus Desulfococcus oleovorans Hxd3
atgacccaaaacgatgtgatgatttattccctgagcacatgcagtcactgcaagtccaccaagcggctgctcaatgaatgcagcgtggcctatgatttcgtggatgtcgatctgaccaccggcgacgagcgcaaggccattctggatgatatcaaaaagatcaaccccaactgcacctttcccaccatcaagatcaacgacagggtgatcgtgggttacaaggagcaggagattcgggaggcgctgggcatttcatga

SEQ ID NO: 7851 - DNA, 264 bp, Desulfovibrio vulgaris  Miyazaki F
atgtccgacgattccaacgaagtgaaactgttcgccctgtccacctgcgttcactgcaagaataccaagcagtatcttgaagagcatggcgtggactacaagtgcgtgttcgtggatcagctggaaggcgacgagcgcaaggcggtgctggaagaaattcgcgcccacaatcccaagctgtcctttcccacgctggtttgcggcaatggccgcgtcatcgtgggcttccacaaggaagacatcaaggaggccctgcatctatga

SEQ ID NO: 7852 - DNA, 255 bp, Desulfomicrobium baculatum DSM 4028
atgcctgacaaagccatcacactctacgcattaagcacctgtatccattgcaaaaaaaccaaagagtatctcgacgactgcggcgccaaatatgactgcgtctttgtcgacaagctcgaaggcgacgaacgcaagcagatcatcgaggccatcaagaagatcaatcccaagctgtccttcccgaccctgctcgtggacgaggaagccatcgtcggcttcaagcaggatcagatcaaagaagccctggagagatga

SEQ ID NO: 7853 - DNA, 279 bp, Candidatus Methanosphaerula palustris E1 9c
atgcagattgaagttgtggatggcagagataaggggaacgtaatgctctatgctctcagtacctgcggatggtgtgcgaagaccaaggaactgttgaagtcgctcggtgtgaagtattcatatctgtatgtcgacaaggttggtcctgatgagcaggaacaggtggtcaaggagatcgagcggttcaatcctcacctctcgtttccaacgctggtgatcgggaacgatcatgtgatcgtgggtttccgagaagacgagatcaggaaggaactggcatga

SEQ ID NO: 7854 - DNA, 255 bp, Desulfohalobium retbaense DSM 5692
atggcagatatcacgctgtacgccctgagcacctgcgtacattgcaaacacaccaaagaatttttggacgaatgcaatgtgaactacgactgcatctatgtcgatcggctcagcggcgacgagcgcaacgataccatccgggaaatcaaaaagctcaatcccaacctttcgttcccgaccctggtcattggagacacgatcatcgttggatacaaaaaggaagacatcgagcaggccctggagaatcactcatga

SEQ ID NO: 7855 - DNA, 303 bp, Methanosarcina barkeri fusaro
atggaattagcggtgatcggtaagagcgaatttgttacaggattcagactggctggtgtcaggaaggtttatgaaaccgcagatatcgcagccactgagtccgttgtaaaatcggtgcttgaagacaaaagtgtcgggattcttgtaatgcataatgatgacattggtaatctgccggaaatgctaaggaaaaacttgaatgagtctgtccagcctacagtagtagcccttggaggcagtggatcaggctcgaatttaagagataagataaaacaagcggtaggtgttgatctgtggaagtaa

SEQ ID NO: 7856 - DNA, 303 bp, Methanospirillum hungatei JF-1
atggagatcgcggtaatcggaaatagtgaattcatcctcgggttcaggcttgccggaataacaaaaacgtacgcggcagaatctgatgaaaaggttgttgagtatgttcacaaggttctcgatgatggtaagatcggaattcttgtcctcaacagcagtgatatggcaaagattccagtacgactccgcactaccctcgaaaactcagttcacccgacggttatcacacttggtgaggaggaaggcggattgtcgatgcgtgagagaattaaacgatcagtgggtgttgatctgtggaagtaa

SEQ ID NO: 7857 - DNA, 300 bp, Methanococcoides burtonii DSM 6242
atggaattagcagtagtaggtagcagcgagtttgtaacaggattcagactagctggtattaaaaagatatacgaagctaaaagtgatgagttggaatctgttgtcacaaaagtgcttaaagattcagatgtaggtatctttgtgatacatgaagatgactttaataaactaccggaaattctgagagatactcttagtgagtctgttgacccaaccgtggtcactctcggaggaactggtgaaagttcgaacttaagggaaaagataaaacaatcggtaggtgtagatctgtggaagtaa

SEQ ID NO: 7858 - DNA, 300 bp, Methanosaeta thermophila PT
atggagattgcagttataggcaatagtgatgcggttatcggattcagcctcgcagggatcaagaaagcctacgaggccacctcggaagaggagctgataaacaagataaatgaggtaatggctgatccgaatgtaggaattctggttctgcatcagaatgactacaacaggcttcccaagaggctgcagtcgaccttatctaactccgttaggcctactgttatcgctatcggaaccgagcaaagcacagagatgagagagaagattaaaagggcaataggtgtcgatttatggaagtag

SEQ ID NO: 7859 - DNA, 303 bp, Methanocorpusculum labreanum Z
atggaaatcgcagtaattggaaataaggagtttgtcttgggattccagctcgctggcatcaaaaagacctactctgcagaaaatcccgaaaaacttgccgagaccattacgaaggtacttgacgacacgaatgtgggcatacttgtgctgcagagcactgaccttgaacagatcccgcgtcgcctgcaggtaatcattgaaaattctgtcaaaccgaccatcgttacaatcggcgggcaggaggcaggtctctccctgagggagcgtataaaacgttcggtgggtgttgatttgtggaagtaa

SEQ ID NO: 7860 - DNA, 303 bp, Methanoculleus marisnigri JR1
atggagatcgcagttgtcggtaccggtgaattcatcctcggtttcaggctcgcgggtgtcagaaagacctacgcggccgagaccgacgagcggctggtcgagcatatcaaccaggtgctggatgacagagacgtcggcatcctcgtgctgaagggcagcgacatggagcggattcccctgcggcttcgcaccaccctcgagaactccgtcaagccgacggtgatcgcgatcggtggagaagagggcggcctgtcgatgagagagagaatcaagagatcggtgggtgttgatctgtggaagtaa

SEQ ID NO: 7861 - DNA, 300 bp, Methanococcus maripaludis C7
atgagaatcggtgtagttggagatcctgatgtagtagttgggttcagacttgctggacttacagatgtctacgaagttaaatcccctgaacaagctgcaaaggcaatagaagaattaaacagcaactccgaaataggattaattattaccactgagagaatcggtgaagaaataagagatactatttcaggtgtaaaaaaagttgttgtagaagtacctgacaaaaacggtcctattgtcagagaaaatgatcctgtgaaagtattagtaagaaacgctgttggtgttgacattaagtaa

SEQ ID NO: 7862 - DNA, 303 bp, Candidatus Methanoregula boonei 6A8
atggagatcgcagttatcggcaacagcgagtttatcctcgggttccgccttgcaggcatccgtaagacctataccgcggaaaacgacgagaaactcctggaaagtgtcaacagcgttcttgcggacggacaggtgggaattctcgtgctcaacagcagcgacatggagcggctcccgcgccggctccgtaccacgcttgagaactcagtcaagcccaccgtcattgcccttggcggcgaagaagggggcctgtccatgagagagagaatcaagagatcggtgggtgttgatctgtggaagtaa

SEQ ID NO: 7863 - DNA, 330 bp, Halorubrum lacusprofundi ATCC 49239
atgagccaggagatcgccgtcgtcgggagcccggagttcacgactggattccggctcgccggcgtgcggaagttcgagaacataccggacgacgagaaggacgagcggctcgacgatgccgtcgaacggaccctcgacgacgagggaaccggcatcatcgtgatgcacaccgacgacctcgaccatctctcgcgggggacccgcgaagcggtcgagggaagcattgagcccgtgctcgtgacgctcggcggatccggcgccggcagcggcgggctgcgcgaccagatcaaacgagccatcgggatcgacctgatggaggaggacgactaa

SEQ ID NO: 7864 - DNA, 324 bp, Halorhabdus utahensis DSM 12940
atgagcaaagagatcgcagtcatcggcagtgcggatttcacgaccgggttccagctggctggcatccggacgttcgccaccatctccgaggatcccgagaccgaggaggtcgacgaggcggtcacgacgatgctcgaagacgacgacgtcggcatcgtcgtgatgcacgatccggacctggaacacctctcgcggtccgtccgcgagcgcgtcgagacgagtgtcgatccggtgttggtgacgctcggcggcggagccgggagtggcggattgcgcgaccagatcaaacgtgcggtcggtatcgacctgatggaggaagactaa

SEQ ID NO: 7865 - DNA, 303 bp, Candidatus Methanosphaerula palustris E1 9c
atggaaatcgcagtgatagggaacagtgaatttatcctcggttttcggctcgccggcatcagaaagacctatgcggcgactgatgacgagaggctgcatgaacatatcaccagtgtgctccaggaccccgaggtggggattctcgtgctgaacagcacggatatggaacggcttccccgccgtctccaaagcacgcttgagaactcggtcaggcccacggtgatcgccatcggcggctccgagggtgacatgtccttacgagagaagataaaacgatcggtgggtgttgatctgtggaagtaa

SEQ ID NO: 7866 - DNA, 324 bp, Halomicrobium mukohataei DSM 12286
atgagtcaggagatcggtgtcatcggcagtcccgacttcacgacggggttccggctggccggcgtacggaagttcgccgacgtgccggacgccgacaaagacgaggaactcgacgctgccgtcgaggagatgctcgacgacgaggagatcggtatcatcgtgatgcacgacgacgaccttgagcacctctcgcgcggggtgcgcaaggacgccgagacgagcgtcgaaccggtgatggtgacactcggcggcggcaccggcagtggtggcctgcgcgaccagatcaaacgcgcgatcggaatcgacctgatggaggaagactaa

SEQ ID NO: 7867 - DNA, 207 bp, Jannaschia CCS1
atgccaagcggcactgttaaatggttcaacaccaccaaaggatttgggttcatcgccccggatgacggcggcaaagacgtcttcgtccacatctccgccgtcgagcgcgcaggttggagcgatctgcccgacgacacgaaactcacctacgagctgcgcgagggccgggacggccgcgaaagcgcggtggagttggtgaaggtctga

SEQ ID NO: 7868 - DNA, 207 bp, Ruegeria sp. TM1040
atgcctactggcaccgtgaaatggttcaacaccaccaagggctatggttttattgaacccgaagaaggcggcaaggacgtgtttgtccatatctccgccgttgaacgctccggcctgaccggtttggcggacaatcagaaagtgggatatgagctgaccgaaggccgggacggccgacaaatggccggcgacattcgcccactctaa

SEQ ID NO: 7869 - DNA, 207 bp, Rhodobacter sphaeroides 2 4 1
atgccgacgggcaccgtgaaatggttcaacagtacgaagggcttcggcttcatcgcccccgatgatggcggcaaggacgttttcgtccacatctcggcggtcgaacgtgccggcctgaagggactcagcgacaaccagaagatcggttacgaactgcagtccggccgcgacggacgctcctctgcaggcgatctgcggctgctgtaa

SEQ ID NO: 7870 - DNA, 207 bp, Rhodobacter sphaeroides ATCC 17029
atgccgacgggcaccgtgaaatggttcaacagtacgaagggcttcggtttcatcgcccccgatgatggcggcaaggacgtattcgtccacatctcggcggtcgaacgggccggcctgaagggactcagcgacaaccagaagatcggttacgaactgcagtccggccgtgacggacgctcctctgcaggcgatctgcggctgctgtaa

SEQ ID NO: 7871 - DNA, 207 bp, Rhodobacter sphaeroides ATCC 17025
atgccgaccggcaccgtgaaatggttcaacagcaccaagggttttggcttcattgcgccggatgatggcggcaaggacgtgttcgtccacatctcggcggtggaacgtgccggcctcaaaggcctcagcgacaaccagaagatcggttacgagctgcagtccggccgcgacggccgctcctctgcgggcgacctgcggctgctgtaa

SEQ ID NO: 7872 - DNA, 210 bp, Dinoroseobacter shibae DFL 12
atgccgactggcaccgtgaagtggttcaatacaaccaagggttacgggttcatcgcacccgacgaaggcggcaaggatgtgttcgtgcatatctcggccgtggaacgggccggcctgacgggcctggccgacaataccaagatcgaatatgagctcagggaaggccgagacggcaggtcctccgcgaccgaattgaaggtcgtgggctga

SEQ ID NO: 7873 - DNA, 210 bp, Dickeya zeae Ech1591
atgtctaagattaaaggtagcgttaagtggtttaatgagtccaaaggattcggtttcattactccggaagatggcagcaaggacgtattcgttcacttctctgctatccagagcaacggtttcaaaaccctggctgaaggtcagcgcgtagagtttgaaatcaccagcggcgctaaaggaccttctgctgctaacgttatcgctatttaa

SEQ ID NO: 7874 - DNA, 393 bp, Rhodopseudomonas palustris HaA2
atgacgcgcatcgtgatcggcattggatttcgcgccgccgcccctcaggcgtcgatcgccgaagtcatcgccgctgcgcgcggcgccgctatgcccgcacaaccgacgcatcttgccgtgcccgacgacaaagcagtgcatccgccgttgatcgcagcggcgacagaagcggcattgccctgcctcgcgatcagtacggctgcgatccggagcgccgccgatcgcatcgcgaccgactcaccgcgcgttgcacgcgcccgcggtgtcggcagcgtctgtgaagcggcggcgctcgccgcggcggggcctgccgcccgccttgcggtgacgcggctgatatcaagcgaccgccaggcgaccgccgccgtcgccatcgaggagccaccgcaatga

SEQ ID NO: 7875 - DNA, 381 bp, Novosphingobium aromaticivorans DSM 12444
gtgatcatcgccgggttcggctttcggtcaggcgtcggcctgccttcgctgcgcgcggcgttcgcgctggcggagcaggggcaaccgccggtgacgcatctggccacggcgcaagacaagctcgcagcgctgctccctctggccgaagcgctgggcctgccgctgatgggcgtggcgtccgatgcactggctgccgtttccacccccacgcgctccatcgccagcctgaacgctcgtcacgtcggcagcgtggccgaagcgtccgcgcttgccgctgctggcgcgggtgcgcgcctgctgtcgccgcgccacatctcccccgatcgcatggcgacgtgcgccattgctgccagtgtcaaccttcagggaaccccgacatga

SEQ ID NO: 7876 - DNA, 363 bp, Jannaschia CCS1
atgatcgtcgcgggctttggatttcgcgcggcggccactacggcaagcctcgccgacgccttccaacgtgcgggaggtcgtgcggaggtgttcgcgagcgccgcagacaaagccacgtcaaaggtctttatcgatttcgcaaccggcatggacgcccgggttctcggcgtaacccctgacagtctggcggcccaacgcacgctcacccaatcacacgcctcgcaggcggcccgtgatacaggttcccttgcagaagccgccgctctggccgccgcgggccccggtgcaaagctactggccccgcgtgtcgtgtccgccgaccggatggccacctgcgccctggccgaaggagaccccatatga

SEQ ID NO: 7877 - DNA, 390 bp, Rhodopseudomonas palustris BisB18
atgagccggctggtgatcgggctcgggtttcgcaacgaagcccccgcggcgtcgatcggcgaggtgttggaagcggcacgcgcgcaggccggcggcgccgccgacaccattgcggtgccggacgacaaatccgtccatgcaggactagtgaatgctgccctcgccgcgggcttgccgatcgaaccgatcgccgccgaagcgatgtgggatgcagacgcagacatcacaacgcgctcggcagcaagcgcaaaacatcgcggcgtcggcagcgtctgcgaggctgccgcgctggcagcagccggcgacggcgcccgcctcgtggtgagccgcatcgtctcggccgatcgcagcgccaccgccgccgccgcaattagcaaggaaccaacatga

SEQ ID NO: 7878 - DNA, 393 bp, Rhodopseudomonas palustris BisB5
atgaccgctgtggtgatcggcgtcggatttcgctcggccgcacgagcatcgtcgatcaccgacgtgatcgaggccgcgcgccgcgctatcgcgccgtggcggccgacagcgttggcgacgcccgccgacaaggccgatcacgccgcgctgctcgaagcggcaagcgctgcgtccctgccggtgcgtccgatcgacgaaacagctctccggcagagcgccggtctcgtcgccacgtcgtcgccgctggtcgtgcagcaccgtggcgtcggcagcgtctgcgaggccgcggcgctcgccgccgcgggtcccgccgcgcgcctgctcgttccccgcctgatttcccaggaccgccttgcgaccgccgccgtcgccatcgaggagcccacgccatga

SEQ ID NO: 7879 - DNA, 363 bp, Ruegeria sp. TM1040
atgatcgttgcaggctttggcttttcaaaccgcgcctctgaggccagctttgccgaggcttttgccgcattggacaggcgcccggattgggtggccgttttgcgcaacaaagccaagagcccggtgtttcgcgcctttgcccttgcagaggggctgcgtgtggaacccctcgaggagtatcagatttccggggcccagaccccgaccctttcgccgcgcatccacgcgcggtttgacaccggatctgtcgccgaagcctgcgcccttgtggcagcgggcaaacacgcgcgcctaatccaaagacgatttgtgaccacggatgggcttgccaccgtggcgcttgcggagacaatagcaagatga

SEQ ID NO: 7880 - DNA, 375 bp, Rhodobacter sphaeroides 2 4 1
atgatcgtggcagggctcggcttccgggagagcgcgaccgaggaggagctggccgcggcgctgggcgatgaggcgcccgagcttctcgccacgctcgaggcgcgcgcggccctgcccgcctttcaggcgctggcccggaggctcgggctgccggtgcgcgcgctgcccgaggccgcgctcgccggcgtcgccacccccacccgctcggcgcggatcgaagagcggttcggcaccggctcgatcgccgaggcggcggcgctggtggccgcgggccccggcgccaccttgatgcggacccgccggatcgccgggcccgtgacgattgccgtggcccgctcggccgcggatcctgacagaaagggagccacggcatga

SEQ ID NO: 7881 - DNA, 351 bp, Paracoccus denitrificans PD1222
atgagggtcgcgggcatcggctttcgtcaggcggcaagccttgcctcgctggccgacgcgctggcccgcgccggagcggccgaggcactggcgaccagtccggccaaggtggcggcgccggcgatccgggctttggccgcgcagaccggcctgccgctgctggccgtcgaggtcgccggcatcgcaacccccacgcaatcgccgcgtatcctcgcgcggcacggcaccggctcgctggccgaagccgccgccctggcagcactcggccccggcgcgcgcatcgtcgcgtcgcgcgtaacctcgcaagacgggatggccaccgccgccatcgcagaaggagaccccgcatga

SEQ ID NO: 7882 - DNA, 375 bp, Rhodobacter sphaeroides ATCC 17029
atgatcgtggcagggctcggcttccgggaaagcgcgaccgaggaggagctggccgcggcgctgggcgatgaggcgcccgagcttctcgcgacgctcgaggcgcgcgcggccctgcccgcctttcaggcgctggcccggaggctcgggctgccggtgcgcgcgctgcccgaggccgcgctcgccggcgtcgccacccccacccgctcggcgcggatcgaagagcggttcggcaccggctcgatcgccgaggcggcggcgctggtggccgcaggccccggcgccaccttgatgcggacccgccggatcgcgggacccgtgacgattgccgtggcccgctcggccgcggatcctgacaggaagggagccacggcatga

SEQ ID NO: 7883 - DNA, 381 bp, Rhodobacter sphaeroides ATCC 17025
atgatcgtggccgggctgggctttcgcgagagcgcgaccgaagaggatcttgccgcggcccttgcgctgctgggcgagatgcccgaggtgctggccacgctggacgcgcgcgcggcgctgccggcgctgacggcgctggcccgcaggctcgggctgccggtggtggggctgccggaggccgcgctggccggcattgccacccccacccgctcggcgcgaatcgagcagcggttcggcaccggatcggtcgccgaggcggcggcgctggtggccgcgggccccggcgcactcctgacgcggccccgccagatcgcggggcccgtgaccatcgccgtggcccgagcggccgcggaatctgacagcaagagagccacggcatga

SEQ ID NO: 7884 - DNA, 498 bp, Delftia acidovorans SPH-1
gtgaacccggacgaagccatcccccaccgctgcggcgtgctgggcctgggcctgcacaccgacgcactgccccatgcgctgcaggcgctgtggcagcgggcgcaggcgcagctgccggaaagcgcagacgcaagcgcctgcgcgccccagcccatctgcgccgtggccgtgctggacaccaaggccggccacccggcgctggccgcctggatggcggctatcgtgcctacggccgttctggtgcgcgtgccgccaggacaactgccagggcagcccgtggtcacgcagtcgccgcgcatgctggcgcgctatggcacgggcagcgtggccgaggcggcggcgctggccgccgcaggcccgcactccgccctgagcgtgacccgtctggtggcggacgacggcagcgccaccctggccctggccgtgggccagggcggacctctgaactgttgcctggcccacgccagccaggccaagaaacaaggagcaacggcatga

SEQ ID NO: 7885 - DNA, 393 bp, Rhodopseudomonas palustris TIE 1
atgaccacggtcgtgatcggcgtcggctttcgttccgccgcatccgcgtcttcgatcatcgacgtgatcgagaccgcgcgccgcgccgtcgccccgcatcaactgtcagcgctggcaaccgctgccgacaaggccgaccacagcggcttaagtgaggctgcggcaatgacaactttgcccgtgttgccgatcgatgcggcagcgctcgatcaagccgccgcgcgtatcaccacgtcctccgccgttgtcgcgcatcaccgcggcgtcggcagcgtctgcgaagccgcggcgctggctgccgccggaccgaccgcgcggctgatcgtatcccgtttgatctcacaggatcgcctcgcgacggccgcggtggcgatcgaggagccgctgccatga

SEQ ID NO: 7886 - DNA, 369 bp, Methylobacterium chloromethanicum CM4
gtgagcgccctcgtcgccggaatcgggttccgccgcggcacgccggccgccgagatcgtcgcgctgctgggccgcgcgctcggggaagccgcctccgtgaagctctgggccctcgccaccgccaaccgtgccgacgagcccgcccgcgccttcgggctggtggccctcggcgttgcgccggaggcgctcgcggccatcgacgtgcgcgttcccacgcgctccccccggatcgaacagctgcgcggcgtcggctcgctggcggaggccgcggtgctcgcggcggccggcgtcgaagcccgcctcatcctgccccgcatcgcgagcgcaggggcgacctgcgcgctcgcgcggaccgagccacgatcatga

SEQ ID NO: 7887 - DNA, 216 bp, Rhodospirillum rubrum ATCC 11170
atgaaagtcaccatccgcaagcgtcccgatggcttcgaggcctatgtggccaaaaaggacatggaagaaaagatcgtcgccatggaaaaggaagggctgtgggggggctgggtgaagctggccaacggctggaccttcgagatgcccgacaacgaccccgagacccgcctgccgatcaccgtggaggcgcgaaagatctcgggcggtgaggactag

SEQ ID NO: 7888 - DNA, 216 bp, Rhodobacter sphaeroides 2 4 1
atgaaggtgatgatcagcgaaggcgccaagggcttcgtggcctatgtggccaagaaggacctcgaggagccggtggtggccatggaaaagcccggcatgtggggcggctgggccaggctcggcaatggctggatcttccagatgcccgcctatgacgcgccgcccgcgctgccgatcacggtcgaggcgcgccgcctgaccgaccgggaggaatga

SEQ ID NO: 7889 - DNA, 216 bp, Rhodobacter sphaeroides ATCC 17029
atgaaggtgatgatcagcgaaggcgccaagggcttcgtggcctatgtggccaagaaggatctcgaggagccggtggtggccatggagaagcccggcatgtggggcggctgggccaagctcggcaatggctggatcttccagatgcccgcctatgacgcgccgcccgcgctgccgatcacggtcgaggcgcgccgcctgaccgaccgggaggaatga

SEQ ID NO: 7890 - DNA, 216 bp, Rhodobacter sphaeroides ATCC 17025
atgaaggtgatgatcagcgaaggcgcgaagggcttcgtggcctatgtggccaggaaggacctcgaggagccggtggtggcgacggagaagcccggcatgtggggcggctgggcgaggctcggcaacggctggatcttccagatgcccgcctacgacacgccccccgcgctgccgatcacggtcgaggcgcgtcgcctcacggacatggaggactga

SEQ ID NO: 7891 - DNA, 213 bp, Bradyrhizobium BTAi1
atgatccgtcgctcgccggaaaccggcctctcgatctacgtcccgaaaaaggacctggaggagccgatcgtcgagaccgagcacgagaccctgtggggcggctggatccgcatcgccaatggctgggtgctcgagctgccgcagatggccgccgacacgcggctgccgatcaccatcaatgcgcgcaagcgcggtggagaaggggacgagtga

SEQ ID NO: 7892 - DNA, 216 bp, Xanthobacter autotrophicus Py2
atgaagattatgattcgccgttctccggagatgggcctgtccatctacgttcccaaaaaggaccttgaggagccgatcgtcgagaccgagcacgagaccctgtggggcggctggatcaagatcgccaacggctgggtgcttgatctgccggagatggccgagggcacgaccctccccatcaccgtgaacgcgaagaagcgcggcgaggaggagtga

SEQ ID NO: 7893 - DNA, 219 bp, Methylobacterium sp. 4-46
gtgaagctgatgatccgcagatcgccccgcggcggcctctcggcctacgcgcccaagaaggacctggaggagccgatcgtcgccatggagcacgacgccctctggggcggctgggtgcggctgaagaacggctggaccttcgtgctgccggcgctgccggccgagacccgccttccgatcaccgtcaacgcccgcaagctcggcgacgaggaggagtga

SEQ ID NO: 7894 - DNA, 216 bp, Gluconacetobacter diazotrophicus PAl 5 JGI
atgaaagtcatgatacggcgcgacgcgcgtggcctgtccgtttacgtcccccgcaaggatctggaagagccggtggtggcccagcaatccgaggcattgtggggcggatgggtcaggctgaagaacggatgggtgctggaactgccggagatggacgccgaaacgcgcctgccgatcacggtgaatgcccgcaggcttgaagggggtgccgaatga

SEQ ID NO: 7895 - DNA, 219 bp, Methylobacterium nodulans ORS 2060
gtgaagctgatgatccgcaagttgccccgcggcggcctctcggcctacgcgccgaagaaggacctggaggagcctattgtcgccatggagcgcgaggccctctggggcggctgggtgcggctgaagaacggctggaccttcgtgctgccggcgttgcccgcagacacccgcctgcccatcaccgtccatgcccataagcttggcgaggaagatgagtga

SEQ ID NO: 7896 - DNA, 903 bp, Methylococcus capsulatus Bath
gtgcagcaaaccggggtcgtgctcgaacccgcacggcagcgactcgctggcatcgaaacgcgcatcctggatgccgtcgagtaccggcccgaaacgagatcactgggccgcatcgtggatctccagccattgctcgaactgcgctcgcgctaccgcgccgcccaggccgaggccaagatcaccgatgccgcgctgcggctcgcccgcaagaaccgtgaccggctcgccagcctgcacagcgaagccatcgtcgccacccgcgaactgatccacgccgaatcccaactcgccgccgacgaggcacgggccgtgacggcgcgccagcatgtccgggagttgcaggaggaaggtctgcaggcgtggggcacggagctgttccaggccgccgtggccggggactcccgcttgttcgacgatctgctgcaacggcgccgggtgctgctcctggtcaccctgcaccacggccaggcgctgcctgcggacgccgcccgtatcatggtggcgcgggaaggtgaccggcaggcggcacagcccgccgaactggtctcggcggcgccgaagaccgacgacatcgtgcaaggggaaacctggttctttcacaccgatgcccgcaagttgcgtaccggcatgcgtatcgaggcatggattccggcctccgccgaaaagctgagcggcgtcgtcattccccgctcggcgcagatctggcacgagggccggccctgggtctacctgcggatcggcgcagaccgtttcgtgcgaaggccgatcgatgctcatcgcgactacggcgacgcctggttcgtcgacgaagggatcgagccgggcgcttcgctggtgacgcggggggcgcagctgctgttgtcggaggaacagcgccacgcgatccccgaagaggacgactga

SEQ ID NO: 7897 - DNA, 1065 bp, Burkholderia thailandensis E264
atgaaacgtcgactgctcatttgttccgccgtctccgtgctgctggtggcgggcgccggatggtacgcctatcgggtctacgcgccgcccgccccggcatggcccgcggcgacgccggcaatgccccgctccgccgtgcagaccgtcgacggtgaaacggtcgtcgtcgtgccgccggacgagcagcgtgccagccgcatcgaaatcacgcagttggccgcgacgacgatccgctccgagcgcaccgcatatgcaacggtcatcgatcttcagccgctgttcgacctgagcaaccggctcgcgacggcgctcgcggatcgcgacagcgcgcgcgagctggccgcgacatcgcgggcgcagtacgcgcgcagccgcgcgctgtacgcggacgaccgcaacatttcgcaaaaggcccttcaggatgcgcaggcggcagcgcaggtggcccgtgccaggctgcagtccgcggatgcgacgcaaggcgcattggccgcgacgatgcgccagcagtacggcgctgcattgacgaatgcggcgatgacacctcattccgggctatttcagcgcctgctcaccggccagacggtgatcgtgcgcgtgacgttgccgtccgacgacggagacgccgcccccgagcgcatgaccatcgacggacccgacggccgtccggtgcccgtgcgcaagctctctgcctcgccgcaaggcgatgcggccgtgcagggaatgccgtggctctatgcggccgagcgcatgctgcccgtcggcacgcgcaccagcgcgcacgtgcccgcgccgaacggcggcgcatccgcgctcgtgatccccgagcgcgcggtggtctggtatggcggacagccgtgggcctatgtgcgcaccgcgcccgatcgcttcacgcgccgcgccgttgcggcggattccgcaggcggccggggtttcgtcgtgacggccggctttcatgccggcgattcgctggtgacgcagggggctcaattgctgctgtccgaggagcaaaagccgcagggcatcgcgacggcttgcaaggacccgcccgaatgcgacgactga

SEQ ID NO: 7898 - DNA, 945 bp, Bradyrhizobium BTAi1
atggcctattccactgggccggtgctggcccagccggaagggcgcgagccggcgacggtcaagctttccgcagcgcagcagaagcaggtcggtctgcagaccgcggtgctcacggcggaatcccatcccgagcaatttcgggcctatggcgcggtgctggatgtcgcccgcctgaccgacctcaccaacagctacgcgaatgcccaggcgcagctgcagacggcgcaggcgaagctcgaggtcgcaaggctcgccttcgaccgcgcccgcgacctggtgcagtcggcagcgatgccgaagaaggacgcggaagcggctgaaggaacgtttcgcaccgatcaggccgccctcgccgccgcggaatcgcaggtgaagacgttgatggccaccgcgcggcaggaatggggtccggtgatcggaaagggcatcgtcgagcgctcgccgcaggtcgtccagttgatcgaacgcgagcagttgctgatccaggtcacgctgccgcctggcgtgtcgctggccgtgccgccgcgcaccgcgctcgcccagacgccagggcgcaccgccaataccgatcttctttacctgtcgccggcgccgcgaaccgatgcccgcatccagggtgtgagctatttcttcgtggccgcgggcgacagcggattgctgccggggatgaacaccacggcctacgtgccgtccggcaagtcattcgacggcgtctttgtcgaggataccgcgatcgtgcaatggcaggggcgcgcctgggtctatctccgggccggccccgagacgttcaagcggcatccgatccgaaccgaccagcccgtttccgacgacgactatgtcgtgcaggacattccgccgggctccgagatcgttctgcgcggcgcgcaggtgctgttgtcggaagaggccaaaagcgagcttcgcggcggcggcgacgatgattga

SEQ ID NO: 7899 - DNA, 1107 bp, Methylobacterium extorquens PA1
atgcggcgggtcgtcctgcccgtggggctggcgctcggcgcgggtgcgctcggcgcgctcacgctgacagaagccggcatcggcctgcgcgtgaaggccggccccgtcctctcggacctgcatgatcggttttccggggttgcgacgcccgcggcgcatcagacgccgaccgcaccgagccccccgccctcgcgagtcgcggtggaaggcggtcaggccgtcgtgcggctgaccgatgcggagcaggcgcggatcggcgtcgcgacagcccgccataagcggatgccccaccgcatcgaggtccaggccttcggctcggtcctcgatctcgcgcgggtcacggagctcaccaacagctacgccagcgccagggcgcagttgcagaccgccgaagccaaggcggaagtctcgcgcgccgcctatacccgggcgcgcagcctcggccaatacgcgacacaggtgcagctggagacggccgagggcaccttccgcaccgacgaggcggcgctcgctgcggcgcagtcgcaggtccggacgcttgcggccaccgcgcagcaggaatggggcacggtgatcgggcgggccatcatcgagcgttcgcccgccatcacccggctgatcgagcgcaccgacttcctggtgcaggtcacgctgccgcccggcgagacgctgcgggcgccgcccggcacggcccatgccgaggtgccgccgcagagcgagcgcgtcgccttgcgttacgtctcgcccgcgacccggaccgatcagcgcatccagggcgtcagctacttctacaccgtggccggcaatagcgggctcctgccgggcatgagcacgctcgccttcctgacctcggagcgcgagacgacgggcatcgccgtgccggaaagcgccgtggtgcactggcagggcggcgcctggatctaccggagcgtcggcgacgacgcctttgcgcgccatcccctccgggccgacgcgccgatctcggccgacgcctacgtcgtggacgatctcggcgcggaggcggagatcgtcgtgaccgggccgcaggccgtcctctccgaggagctgaaggggcagatccagtcctcggatgcggacgacgattga

SEQ ID NO: 7900 - DNA, 1110 bp, Methylobacterium radiotolerans JCM 2831
gtgagtggtcgccgggcgctgctgctcatcggagggatcctgctggccgcggccggtctcgctgtcacgccgacgggcgaacgccttcgcgccgatgccggcccgctggtcgcggaggtgcgggcgcgcgtcgcggcgctgatccccgcacggcgggacgatacgtccacggccgcgcagctgccggcgccgcgcaccgccatcgaggacggccggaccctggtccggctgacgccggccgagcgcacgcggatcggtctcgtcgccgaggcgcgacccgccatccttcaccgacaggaattgaccgcctacggcagcgtcctcgatctcgcccgcatcaccgaactgaccaacagctacgcgggcgccgtggcggcgctccagacggcccgcgcccgggtcgaggtctcggccagcgccgcccgccgcgcgcggactctcggggccggggtggtggcggtggcgcagatcgagaccgccgagggcacgctcctgaccgatcaggcgtcggtcaccgcggcggagtcgcaggtgcgcaccctcgcggcgacggcgcgccaggaatggggccctgtgctcggcaaggcgatcatcgagcggtcgcccctggtgacgcgcctgatcgagcggaccgacttcctcgtgcaggtgacgctgccaccgggggagactctgccggaggcgccgcgggccgctttcgccgaggtgccaccgcagagcgagcgagtcgccctgcgactggtctcgccggcgacgcggaccgatccgcggatccaggggcagagcttcttctacctcgtctccggcgacagcggcctcctgcccgggaccagcacgatggcgttcctggcggcgccgcgggcggtgaagggcgtgctcgtgccggaggacgccgtcgtccacggggagggcgggacctgggtgtatcgcggggccggcgacggcgccttcgtgcgccatccggtgcggccggacgccccgatggcggccgatgccttcgtggtcgaggatctgccggacggcagcgagatcgtgctgcggggcgcgcaggccctgctctcggaggagatgaagagccgcatccgcgtcgtgggcgacgacgatgactga

SEQ ID NO: 7901 - DNA, 1107 bp, Methylobacterium populi BJ001
atgcggcggcgggtcgtcctgcccgtggggctggcgctcggcgtgggcgtgctgggtgcgctcatgctgacggaggccggcaacggcctgcgcgtggcggccggtccgagcctttccgacctccacgacaggctgtcccgggccacgacgcccgcggcgcaccagccggcggcgcaaggccgcccatcggtgcgggtcgcggtcgagggcgggcgcgccgtcgtccggctgagcgacgaggagcgggcgcggatcggcgtcgccacggcacggcacgtccaggcctcccaccggatcgaggtgcaggccttcggctccgtcctcgacctcgcccgggtcaccgaactcaccaacagctatgccagcgccaaggcccagttgcagaccgcggaggcgaaggcgggcgtctcgcgcgcggccttcgtccgggcgcgcagcctcggcccgtacgcgacccaggtccaactggagacggccgagggcaccttccgcaccgacgaggcggcactcgccgcggcgcagtcgcaggtccggacgctggcggccaccgcgcagcaggaatggggcacggtgatcggacgggcgatcatcgagcgctcagccgtcatcacccggctgatcgagcgcacggacttcctcgtgcaggtgacgctgccgcccggcgagaccctgaaggcgccgccggccacggcctccgccgaggtgccaccccagagcgagcgcgtggcgctccgctacgtctcgcccgcgacccggaccgaccagcgcatccagggcgtcagttccttctacaccgtggccggcgacagcgggctcctgcccggcatgagcacgctcgccttcctcacctcggagcgcgagaccaccggcatcgcggtgccggagagcgcggtggtgcactggcagggcaacgcctggatctaccggagcgtcggcgacgacgccttcgcccgccatcccctcaaggccgacgcgccgatctcggcggatgcctacgtcgtcgacgacctcggccccgaggccgagatcgtcgtgaccggaccgcaggcggtgctctccgaggagttgaagggtcagatccaggccgccgacgcggacgacgactga

SEQ ID NO: 7902 - DNA, 1107 bp, Methylobacterium chloromethanicum CM4
atgcggcgggtcgtcctgcccgtggggctggcgctcggcgcgggtgcgctcggtgcgctcacgctgacagaagccggcatcggcctgcgcgtgaaggccgggcccgtcctctcggacctgcatgatcggttttccggggtggcgacgcccgcagcgcatcagccgccgaccgcaccgagccccccgccctcgcgggtcgcggtggaaggcggtcaggccgtcgtacggctgaccgatgcggagcaggcgcggatcggcgtcgcgacggcacgccataagcggatgccccaccgcatcgaggtccaggccttcggctcggtcctcgatctcgcgcgggtcacggagctcaccaacagctacgccagcgccagggcgcagctgcagaccgccgaagccaaggcggaagtctcgcgcgccgcctacacccgggcgcgcagcctcggccagtacgcgacgcaggtgcagctggagacggccgagggcaccttccgcaccgacgaggcggcgctcgccgcggcgcagtcgcaggtccggacgctcgcggccaccgcgcagcaggaatggggcacggtgatcgggcgggccatcatcgagcgctcgcccgccatcacccggctgatcgagcgcaccgacttcctggtgcaggtgacgctgccgcccggcgagaccctgagggcgccacccggcacggcccatgccgaggtgccgccgcagagcgagcgcgtcgccttgcgctacgtctcgcccgcgacccggaccgaccagcgcatccagggcgtcagctacttctacaccgtggctggcaacagcgggctcctgccgggcatgagcacgctcgccttcctgacctcggagcgcgagacgacgggcatcgccgtgccggaaagcgccgtagtgcactggcagggcggcgcctggatctaccggagcgtcggcgacgacgcctttgcgcgccatcccctccgggccgacgcgccgatctcggccgacgcctacgtcgtggacgatctcggcgcggaggcggagatcgtcgtgaccgggccgcaggcggtgctctccgaggagctgaaggggcagatccagtcctcggatgcggacgacgattga

SEQ ID NO: 7903 - DNA, 483 bp, Brucella suis 1330
atggaccgtgtgaaggcgatttttcaaacggcgcggctggctcttgctggtggctttctgctggcagcaatggctggcgccggtgcggcagaccgcattgcttttgtcgtgccttcggcgaccgtctatcccggacaaatcgtgagcgataccgcgcttctggaaaagcagttcttcatcaatgcgcctgcggcgacccaatatgtgctgtcgctggatcaggcggtgggcaaggtggcgcgcaagacgctgcttcccggcaagccgatcctcgtttcggcactgggcgagccgtctctggtcacgcgcggcattcctgcaccactggtctttaccgccggcacgctgactataactgcgatgggtacaccgctcgaatccggtgtggctggcgatttcatcaaggttcgtaacgtcgatagcggcatcatcgtgtccggcacagtgctcgcaaatggtcgtattcaggtggggatgcagtga

SEQ ID NO: 7904 - DNA, 486 bp, Rhodopseudomonas palustris BisB18
atggccttgatgcgcgccatatccaccctcgttcgacgggtctggtcggcggcgttcgtcgccaccgtgatctccgcgagcgcgctcgcggaggagccggcgcgctttccggttcccgccacggtgatctacccgggcgacttgatcaaagacgagatgattatcgatcgcagcttcgcgccgaacctgccgggcgttgccgccttcgtcggcgaccggccggcggtggtcggccggatcgcgcggcgcacgttgctgcccgggcagttgatcccgatcaacgccctcgaggagcagaagctcgtgtcgcgcggcagtgtcgtcaaggtcgtcgtcgaggacgggtcgctgtcgatcgtgacctacggctcttcgctgcaggccggcagccccgggtcgatgatccaacttcgaaatctcgataccggcgtgaccatccgagggatcgtgcagccggacgggtcagtgcggattcaaaacggatga

SEQ ID NO: 7905 - DNA, 474 bp, Mesorhizobium BNC1
atgcgaagcggcgcaggcacgagaaggattttcctggcggggctgcttgccgcgctacctcttttcgctatgcccgcgcatgcgcaggaggtggtcgtggtgccgacgcgggtgatctaccccggcgagactgtctccgcggaagcgcttcaggagatgatgctgcggcagcccccgcgcggggctgcctccatcgcacggacacccggcgacctggaaggcaaggttgcgcgccgcacgcttttgccgggacggcttattcccctctcctatgtacgcgagccatatctggtggagcagggttcgactgtcacggcggtcttcaccgacggcccgctgacaatctcggtcctggcagtgccgctgcagccgggcgccgcaggcgatttcatcaaggtgcgcaacgtggacagcggcgcggtcttcaccgggatcgtcatgcaggacggcaccgtcaaggtcggggcgtcatga

SEQ ID NO: 7906 - DNA, 459 bp, Bartonella bacilliformis KC583
atgaaacaactttcgcttttgctggtgaatgtttttttctcactctgtttattgactgcggcttatgctgatcgggttagttttcttgttcctgagcggtcaatttatgttggtcagcgtgtgagtgatgtcggtttaagcgaaaagaattttattattaagtctgaagctgcttctttatatgtcattgatatgaagcaggttctgaataaggttgcaacccgtcctttaagagcggggcgtcctattgcccttactgctttgggtgatccggttttggttgagcgtggtcagacaatcaaattgatttttcagtcagataatttacaaatcactgctattggtgtggtgttgcagtcagggtcttcgggggatgttgttcgagtgcgcaatgctgattcagggcgcattgtgatgggaactgtcttacaaaatggtagcgtgagggtggggtcataa

SEQ ID NO: 7907 - DNA, 510 bp, Sinorhizobium medicae WSM419
atgatgtttcgccgatccgccggaggaaaagcaatcgcaggcggtcgcgcgcggccagtccgtgccgtcctgcttgccgcggttgcgagttgcatgcttccgccggcctctgccctcgcagagaagccgacggccgtcatcccgaagcagacgatctatcccggcgagacgctcgatgcgagcatgctggaggtggtcgacgtgaccaacccggacctgcgcgacggctatgtgcgctctctcgacgaggtcgacggaatggtgaccaagcggacccttcttcccggtcgggtgatcctcgcctcggcgctgcgcgagcaatatgcggtggagcgcggttccacggttcgaatcgttttcagcaatggcggtctgacgataacggccgccggctcgccgctgcaggacggcgccatcggcgagttgatccgcgttcgcaatatcgacaccggcgtgatcgtctccgggacggtgatggcggacagcacgatccatgtggtggcgaaatga

SEQ ID NO: 7908 - DNA, 483 bp, Ochrobactrum anthropi ATCC 49188
atgggctgtgtgaaggcgatctttcaaaagaaaaggctggttcttgccggtggcttcctgcttgccgcaatggctggtgcaagtgcggcagaccgcatcgcctttgtggtgccttcggccaccgtctatcccggccagatcgtaagcgatacggcattgctggagaagcagttcttcatcaatgcgccggcggcgacccaatatgtgctgtccccggatcaggcggcaggcaaggtggcgcgcaagacgctgctccccggcaagccgatcctcgtttccgcattgggggagccgtctctggttacacgcggtgtaccggcgccgctggtctttaccgccggtacgctgaccataaccgccatgggcacgccgcttgaatccggcgcggttggcgacttcatcaaggttcgtaacgtcgatagcggcatcatcgtgtccggcacggtgctggccaatgggcgcattcaggtggggatgcagtga

SEQ ID NO: 7909 - DNA, 495 bp, Methylobacterium extorquens PA1
atgccccgcaagaccttcgtccgcggcctcgtgctcgccgccctcgcggccggctcggcgcagcccatcgccccggcgcaggccgtcgagggcatggcgaatgccgaactcatgctgccggtgccgaccgtcacgatctatcccggcgacacgatcaaggaatcgatgctgcgcatgcaggcctatcccgcgacctaccgggcgcgcacggcggtcatcgatgcctccgccgcgatcgccggccgggtcgcccggcggatgctgctgccgggtgagccggtgccggtcaacgccgtggacgatccccgcctcgtgagccgtggcgcgccgacgcagatgatcttcgaggagaacggcctcgtcatcaccgcggtcggagcaccgctccagaacggcggcctcggcgagacgatccgcgtgcgcaacaccgacaccaaccgcatcatcctcggcacggtgatggccgacggccgcatccggatcggcgcgcaatga

SEQ ID NO: 7910 - DNA, 429 bp, Methylobacterium radiotolerans JCM 2831
atggcgaccgtcatggcgaccgggcccgccatcgcggcggaacagatgctgccggtgccggtcgcgacgatctacgcgggcgacgtcatcaagccgaccatgctgcgcgagcaggcgttccccgagggctaccggccgcgcctgccggtggccgacacggcggcccgcgcggtcggtcgcatcgcgcggcggacgctcctgccgggcgagacgatcccgtcgatcgcgctggaggaggcgaagctcgtgacccgcggcgcgccggccgtgatcgtcttcgaggagcacggcgtcacgatctcgaccgtgggcacggccctggcgaacgcggcggtgaacgaggcggtgaacgtgcggaacgccgccacggggcgggtcgtccagggcatcgtccagccggacggccgcgtgcggacgggacagccgtga

SEQ ID NO: 7911 - DNA, 501 bp, Beijerinckia indica ATCC 9039
atgcaccggaagccatggtttctcatatcaagcttacgctttctcccattgggtgtcgcggcgtgtttgtcgacactctctgcggtccatcccgtggaggcttccgatgcgctggttctccccgtcccgaccaccacgatctatccaggagatacaatcaaggaagcctggatcatcgagcgggaatttgccgccaattccacttatgcccgaggcaatgttctgacagaacgcgccgccctcgtcggcaaagccgcgcgccgcacacttcttcccggcgtccctattcccatcaatgcgctgagcgaacccaaagcggttttaaacggcgccaaagtgcgtatcgtcttcatggaaagcggtctgacgatcacggctttcggctcggcgcttcaatccggcagtgtcggcgacaatgtcagcgtacgcaatctcgatagtggcttgaccgtttccgggatcgtacaagccgacggttcgatacgggtgagcggcagctga

SEQ ID NO: 7912 - DNA, 489 bp, Methylobacterium populi BJ001
atgctccgcaagaccttcgtccgcggcctccgcgccgccgccctcgctgccggcctcgcggcgggtccggcccacgccgtggacggcatggcgaatgccgaactcatgctgccggtgccgaccgtcacgatctatcccggcgacacgatcaaggactcgatgctgcggatgcaggcctatcccgcgacctaccgggcgcgcacggccgtcatcgacgcctccgccgcgatcgccgggcgcaccgcgcggcggatgctgctgccgggcgagccggtgccggtcaacgcggtcgacgatccccgcctcgtcagccggggtgcgccgacgcagatgatcttcgaggagaacggcctcgtcatcacggcggtgggcgcgccgctccagaacggcggcctcggcgagacgattcgcgtgcgcaacaccgacacgaaccgcatcgtgctcggcacggtgaccgccgacggccgcatccggatcggcgcgcaatga

SEQ ID NO: 7913 - DNA, 531 bp, Methylobacterium sp. 4-46
atggtcatgagcagtcgaacccggcgggcgctcgcgctcgccctcctggccggcgcctgcggcgccggcatcggcccctgcgcggccgctcccgccgccggccccgccgccgcgcaggcgccgcccgagcgcgcgcccgacctcgtcctcccggtcccggccgtgacgatctacccgggcgacatgatcaaggagacgatgctgcgcgagcagtccttcccgccgaccttccgcgcccgcgccgccgtgatcgacgcgcccctcgccatcgtcggccgggtggcgcggcgcacgctcctgcccggggagccggtgccggtcaacgcggtggacgatccgcgcctggtcagccgcggcacgcccaccacgatgatcttcgaggagaacggcctcatcatcaccacgctcggcacgccgctgcagaatggcggcctcggcgaggtcatccgggtgcgcaacaccgatacgggccggatcgtcgtcggcgtcgtccagggcgacggccgcatccgcatcggggacatgcgctga

SEQ ID NO: 7914 - DNA, 483 bp, Rhizobium leguminosarum bv  trifolii WSM2304
atgatgttttgccgggcaggacacatctcaggatgggtggcggcagccacgatcgcagtcgcgggcattttcttgcccgcggacgtggatgccggcatgggttatgccgtcgtcccgacgacgatcatctaccccggcgacacattgtcggccagccagcttcaggaggtcgaggtcaccaaccccaacctttccggcgatttcgccaaaaccatttcccaggtcgaaggcctggtctccaagcgcacgcttttgccgggccgcaccatttcggtttcaggtctgcgtgaaccctatacggtcacccgcggttcttcaatccgcctggtcttctcgctcggtgcgatgaccatctcagcggccggctcgccgctcgaagacggcgccacagggcagctgatccgcgcgcgcaatatggattccggtgtcatcgtcagcggcacggtgcttgcggacggcacggtccatgtgagggcaaaatga

SEQ ID NO: 7915 - DNA, 447 bp, Methylocella silvestris BL2
atggtgggatttgtcgcaatctgcctattcggccgaataccggcacatgccgccgagtcccatgccctgccggttccggcgatcacgatctatcccggcgatcccatcaaggatgagtggctggttgatcgcgacttcggagctacgtcgccgttgcgcggcaatgtggtcacgaaccgaagcgccatcatcggcaagattgcgcgtcgcacgcttctgccgggagcgcccattccggcaaatgtggtggcggagcgcaagattgtcggcaatgggacgaaggtcaggattgtctttgagcagcccgggatcgaaatcgcgacctatggcgcggcgctgcaggacggcgccttgggagacgtgatatccttgagaaacatcgagaccggtcttaccgtaactggcgtggtgcaggcggacggctccgttcgggtgaatggcggatga

SEQ ID NO: 7916 - DNA, 495 bp, Methylobacterium chloromethanicum CM4
atgccccgcaagaccttcgtccgcggcctcgtgctcgcctccctcgcggccggctcggcgcagcccatcgccccggcgcaggccgtcgagggcatggcgaatgccgaactcatgctgccggtgccgaccgtcaccatctatcccggcgacacgatcaaggaatcgatgctgcggatgcaggcctatcccgcgacctaccgggcgcgcacggcggtcatcgatgcctccgccgccatcgccggtcgggtcgcccggcggatgctgctgccgggtgagccggtgccggtcaacgccgtggacgatccccgcctcgtgagccgtggcgcgccgacgcagatgatcttcgaggagaacggcctcgtcatcaccgcggtcggagcgccgcttcagaacggcggtctcggcgagacgatccgcgtgcgcaacaccgacaccaaccgcatcatcctcggcacagtgatggccgacggccgcatccggatcggcgcgcaatga

SEQ ID NO: 7917 - DNA, 480 bp, Agrobacterium vitis S4
atgatgtttcgccatatgaagagaatgttcaggttgaccggggtggccgtcatggtcttggtggctttcgccgccgccccgtcagcggcgcgggatcgttatgcgatcgttccgacggacaccatctatccaggcgaagcgatttcgtccaacaaactggatcgggttcaggtgaccaatcccaatcttgcaggcggctttgcctctgacatggcggatgtggtcggcatgctctcgaccaagacactgctgcccggtcgcactattccgttggcgacgctgaaacgcccctatgcggtgatccgcggatcgcagctgcggctgatcttcaatatcggcaaccttaccatttctgcgtcgggcagcccgatggacgatgccaatatcggcgacgtcatccgcgtccgtaatctcgattccggccagatcgtcagcggaacggtcatgggcgatggcactgtgcaggtgatggcaaaatga

SEQ ID NO: 7918 - DNA, 483 bp, Rhizobium leguminosarum bv  trifolii WSM1325
atgatgttttgccgggcaggacacatctcaggatgggtggcagcagccacgatcgcagtcgcgggcattttcttgcccgcggacgtggatgccggcatgggttatgccgtcgttccgacgacgatcatctatcccggcgacacattgtcgtccagccagcttcaggaggtcgaggttaccaaccccaacctcgccggcgactatgccaaatccatttcccaggtcgaaggcatggtctccaagcgtacgctgttgccgggccggacgatttcggtttcgggcctgcgcgaggcctatacggtgacgcgcggctcttcgatccgtctggttctgtcgttcggcgcgctgacgatttccgccgccggcacgccgctcgaagacggcacgaccgggcaggtcgtccgcgcgcgcaatatggactccggcgtcatcgtcagcggcacggtgcttgcggacggcacggtccatgtgagggcaaaatga

SEQ ID NO: 7919 - DNA, 171 bp, Nitrobacter winogradskyi Nb-255
atggacagcaacgacaagccggccggagaccggatcgttctcaccgaagctcagaagaagcgccggcgcgaacgctcgatcgcgatcgcctgcgcgctcggcgtcctggtcctgctgttcttcgcggtcaccttcatcaaagggccgggcgttctcgtccgtccggtgtga

SEQ ID NO: 7920 - DNA, 159 bp, Rhodopseudomonas palustris HaA2
atggaccagcagagacccggcatcgtgctcaccgaggcgcagaagaagcgccagcgcgaacgatcgatcgcgatcgccttggcgctcgccgtgctggtggcgctgttcttcgcggtgacgatggtcaaggggccgatcgtgctgcaacggccgatgtga

SEQ ID NO: 7921 - DNA, 180 bp, Rhodopseudomonas palustris BisB18
atgattgattcgcaacgcccgaacgcaccgttgatcgacggcgtggtactgaccccggcgcagaagaaatcgcagcgcgagcgttcgatcgcgatcgcgctttcgctcggcgtgctggtggtgctgttcttcgccgtcaccatggtgaagggcgccgccgtgctggtccggccgatgtga

SEQ ID NO: 7922 - DNA, 162 bp, Rhodopseudomonas palustris BisB5
atggaccagccgaggagaccggggatcgttctcaccgaagcgcagaagaagcgccagcgtgaacgctcgatcgccatcgcgctcgcgctcgccgtgctggtggcgctgttcttcgcggtgaccatggtcaagggaccgatcgtgttgcagcggccgatgtga

SEQ ID NO: 7923 - DNA, 165 bp, Nitrobacter hamburgensis X14
atggacaacaagccgaagccggacgagatcgttctcaccgaggcgcagaaaaagcgccggcgcgagcgctcgatcgcgatcgcctgcgcgctcggaatcctggtcgtgctgttcttcgcggtcacactcgtcaaggggccgggcgtcatcgtccgtccgatgtga

SEQ ID NO: 7924 - DNA, 198 bp, Maricaulis maris MCS10
atgacccaagacaatgatctgatgaacgcccgcgaaggcaagcctaccggcgagacgctgaagctgacgcccgagcaggaaaaggctcgcaacaagcgcaatatcgtgatcgcctggtcgctggtcggtttcatggtcgctgtctttgcgatcaccgtcgtgcgcctgagccagaatgcggcgggagcgggcgtatga

SEQ ID NO: 7925 - DNA, 177 bp, Bradyrhizobium BTAi1
atggcgaccgcgatggccgatccgaatgagccagagggcatcgtcctcaccgaggcgcagctgcgcagccgccggcggcgttcgatcgcgatcgccctggcgctcggcgtgctcgtggtgctgttcttcgcggtgacgatggtgaagggccccgctgtgctgaagcggccgatgtag

SEQ ID NO: 7926 - DNA, 141 bp, Sinorhizobium medicae WSM419
atggaaaccgttcaactgagcgaggctcagaagaagtcccgccgcggccgcaacatcgcactcggtatcgtgctggcgtgccttgtcgtcattttctacgccgtcacgctggtcaaggtcggcggcggcatggtgaattga

SEQ ID NO: 7927 - DNA, 183 bp, Parvibaculum lavamentivorans DS-1
atgagcgaacaggatgaaagcgaacggcacaaggtggccgctccgcaatggacggaagaacagttgaagcggcgccgccagcgcaacctcgccatcgcgtggacgctagccggcctgatggtactgttcttcgtggtgacgattgtgaagctcggcggcaatgtcgtgaaccggccgctttga

SEQ ID NO: 7928 - DNA, 186 bp, Xanthobacter autotrophicus Py2
atgagcaaggacaagaagacgccgcgtccctcgcaagaggagggcgtggtgctgacgccggaacagctcaggcggcggcgagcgcgcaacatcgccatcgcctcattgctggggtttctggcggtactgttttacgtcgtgaccatcgtgaagctgggacccaatgtgctgaaccggccgctttga

SEQ ID NO: 7929 - DNA, 165 bp, Methylobacterium extorquens PA1
atgtccgatctccccgaagggatccgtccgctgacgccggcggaggccaggacccgccgcaagcgctcggtcgccatcgccctgacgctcggcgctctggtgctgctgttcttcgtgctgacgatcgccaagcttggaccgcaaatcctgcaacggccgctctga

SEQ ID NO: 7930 - DNA, 165 bp, Methylobacterium radiotolerans JCM 2831
atggcggatcccgagatccagtaccggccgctcacgcccgagcaggaggcgcggcgccgcaagcggtcgatcgcgatcgcgctggccctcggtgcctgggttctgctgttcttcgtgctgacgatcgtcaagctcggaccgcagatcctgagccggccgatctga

SEQ ID NO: 7931 - DNA, 168 bp, Beijerinckia indica ATCC 9039
atgacggaagagaataagccggaaggcatcgtgttgacgccggagcaagagaaaagccggcggcagcgcaatattgcgattggccttgccgtcgctttcttcattctgttgttctatctggtcaccatcgccaaactcggccctggtgtcctcaacaggcctctatga

SEQ ID NO: 7932 - DNA, 165 bp, Methylobacterium populi BJ001
atgtccgatctgccggaaggcgtacgtcccctgacgccggaagaggcgaagacccgccgcaagcgctcgatcgccatcgccctgacgctcggcgccctggtgctgctgttcttcgtgctgacgatcgccaagctcgggccgcaggtcctgcagcggccgctctga

SEQ ID NO: 7933 - DNA, 168 bp, Rhodopseudomonas palustris TIE 1
atggagccagctcataagacgccgcccggtatcgtcctcaccgatgcgcaaaagaagcgccagcgcgaacgctcgatcgcgatcgcagtcgcgctcggcgtgctggtggtgctgttcttcgccgtaaccctggtcaaggggccggcggtactgcaccggccgatgtga

SEQ ID NO: 7934 - DNA, 153 bp, Methylobacterium sp. 4-46
atgagcgacttccccgccctgacccccgaagaggcgcgccgccgccgcaagcgctcgctggcgatcgcgctcaccctcgcggcgctcgtcgccatcttctacgtgctgacgatcgccaagctcgggccgcaggtcctcaaccggccgctgtga

SEQ ID NO: 7935 - DNA, 141 bp, Rhizobium leguminosarum bv  trifolii WSM2304
atggatctcgttaagctcaccgaaaagcagatgaagtcgcgccgcaaccgcaacatcgcccttgggctggtgctcgccggccttgtcgttctcttttacgcgatcaccatcgtgaagatcggtgggggaatggccggatga

SEQ ID NO: 7936 - DNA, 177 bp, Methylocella silvestris BL2
gtgaccgacaaggcgcaaacgccagtgatgacgggcgtcaaactgacccccgagcaggaaaagagccggcgtcagcgcaatctggcgctcgcccttgcgatcggctttttcgtcgtgctgttttatgtcgtgacggtcgtcaagctcggccccgccgtgctggaacggccgttctga

SEQ ID NO: 7937 - DNA, 165 bp, Methylobacterium chloromethanicum CM4
atgtccgatcttcccgaggggatccgtccgctgacgccggcggaggccaggacccgccgcaagcgctcggtcgccattgccctgacgctcggcgccctggtgctgctgttcttcgtgctgacgatcgccaagcttggaccgcagatcctgcaacggccgctctga

SEQ ID NO: 7938 - DNA, 153 bp, Methylobacterium nodulans ORS 2060
atgactgatctcccgaccctgaccccggaggaggtgcgccgtcggcgcaagcgctccatcgcgatcgcgctgaccctcaccgccctggtcgccatcttttacgtcctgaccatcgccaagctcgggcctcaggtcctcaaccggccgctctga

SEQ ID NO: 7939 - DNA, 138 bp, Agrobacterium vitis S4
atggaaacggtcaaacttacggaagcccagaggaaatcgagacgcggtcgcaatgtggcgctgggcctggtgctcgctgggcttgtggtgttgttttacctcgtgacgttggtgaagatcagcggcatgggacaatga

SEQ ID NO: 7940 - DNA, 141 bp, Rhizobium leguminosarum bv  trifolii WSM1325
atggaattggtcaagctcacggaaaagcagctcaagtcgcgccgcaaccgcaacgtcgccctcgggctggtgcttgccggcctcgtcgttctcttctacgtgatggcaatcgtgaagatcggcgggggaacggccggatga

SEQ ID NO: 7941 - DNA, 312 bp, Wolbachia endosymbiont of Drosophila melanogaster
atgactttatataattatacgattattattgtattaatggtgctaggtttatatattattataaacgataaaaatttaatcaagaaaatgataggggtaagcgtcttccaagcatctgttttgttattttacatatctctaggatatataaaaagttccttgcctcctatattggtttcaaatttttattcatatagcaatcctataccccatgttttaatgcttactgctatagtggttggaattgcaacattttcagttggattatccatagcagtaaaaatggaagaaaagtatggaacaattgattaa

SEQ ID NO: 7942 - DNA, 813 bp, Thermobifida fusca YX
gtgaacgacacccctaccctcctgctcgtcatcgtgatcggtgtcctcgtgactgccggggtgacgctgctgctggaacggagcctcacccgcatcctgctgggcgtggtcctcctcggcaacggcgtcaacctgctcatcctgtccgcagggggcgccgcggggggaccaccgctcctcagcctcaccccggaaggggagatggctgacccgctcccccaggcgatgatcctcactgcgatcgtcatcaccctgggcgtgaccgcgttcctgctggccatggcctaccggagctggcagctgcagggcaacgacgaagtccaggacgacgcggaagaccggcgtatcgccaccggcggggagcggcggcgcctgcgccagtacatccgcgcgcagaaacgggcgctgcgccaggcgatccgcgcccagcggatggaactggaagcgcagatcgaagcgcaggacgaactggaagaagccgagcgggcgatcctccgcgaacagatcgcccaggcccgccgcgacctggacgaacgcttggaagccgcggacgacaaagaccgggagcggatcatcttccaagccgaccacgcgcaagcggccgcgctggatgaggccaaacggcgggtgcgggaagcccgcaaggagctcgctgagcaccggcgtgccgaccgggagtacgaacgccgcctgcggcgggagctgcgccagcgcatccgcgcccagaaacggcagctgcgtgcgagcatccgcgcagaacgcgaacgcctggcccgagccgaagacagcgacatgcagggggtggactactga

SEQ ID NO: 7943 - DNA, 336 bp, Ehrlichia chaffeensis Arkansas
atgattttgagttgttttaattacattgtgtctataatattgatggttataggtttgtatgttactactgctaataaaaatcttgtaaaaaaattaatagggttaaatatatttcaaacttctgtattgttattttatatttctattggttatgttagtgatggtaatgtaccaattttaaatgataaagtaatattgtatactaaccctttacctagtgttttgatgttgacagccattgttgttggggttgcaattttagctgttggtttgtcaataattgtaaaaataagaagagcattttcttcaataaacaataaggaaatacgtagataa

SEQ ID NO: 7944 - DNA, 369 bp, Shewanella sediminis HAW-EB3
atggtactaggactctataactactggatcgtggtactgctgatgatgatcggtttctatattgttatcgcccatggcaacctgatcaaaaaattggttggcttaacgattttccaaacctcggtttttatcttttacatcagtatgggcaatgtcgatagcggtagcgcaccaatcttggctgaaggtgtggctcgctactctaaccccctcccccatgtgcttattcttaccgcgattgtggtcggtattgcaacaacggcgctcggcctcgcactggtcgtaagaatcaaagagtcatacggctctatcgaggaggatgagattcaaattcaagatcagctcactgaggataaaacatcgtgctag

SEQ ID NO: 7945 - DNA, 363 bp, Shewanella pealeana ATCC 700345
atgatactgggactctataactactggatcgtggtattactgatgatgataggtttttatatcgtcatcgcccatggcaacctaatcaaaaaattagttggcttaacgatttttcagacctcggtttttatcttttatatcagtatgggcaatgtcgatagtggtagcgcgccaatcttggccgaaggagtgagccgttactcaaatcccctcccccatgtgcttattctcaccgcaattgtggtcggtattgccacgaccgcactagggctcgccttggtggtaagaatcaaagaatcatacggctctatagaagaggatgagattcaaattcaagatcagctgactgaggacaaaacatag

SEQ ID NO: 7946 - DNA, 363 bp, Shewanella woodyi ATCC 51908
atgtttctcggactctataactattggatcgtagtactcttgatgatgattggtttttatatcgttatcgcccacggaaatttgataaagaaactagtcggactgactatttttcaaacctcagtgtttattttttatatcagtgtcggcatggtcgagcgcggcagcgcaccgattttggcagaggggattagtgattactctaacccgctaccccatgtattgatcctaactgccattgtggtggggatagccaccaccgcacttggactggcactggccgtcagaatcaaagaatcctacggcagtgtagaagaggatgagatccaaagacaggatcagcttaacgaggataaatcatag

SEQ ID NO: 7947 - DNA, 402 bp, Desulfohalobium retbaense DSM 5692
atggatgccattttatccactcttttgggcaaatataactattggatttatattgccctcatgatgcttgggctttgggcaattatcgccaagaataatctgatcaagaaaattatagggctgaacatttttcaaaccggcattatcctgttttacatctctattagtgccaaaaaagacgcaacgattccaattttgatgcatcatggaggtcacggagggcatgaagccattcatgcagtcaattatgtcaatccgttgccacaagttttgatgctcaccgccattgttgtttcagtggcaacactcggtgtggcattggcgttgagtattcgtctgtatcaacgctacaagtcgctagaagaggatgaaattctgacccagttgagagaagaacaatga

SEQ ID NO: 7948 - DNA, 333 bp, Ralstonia solanacearum
atgacatggtccaccaggaagatgcgccggtcgggaacgtggcttgctgccgcgctgcttggcctggcgagcgccacggcaggcgccaggctgcccccgccgaccgccgagcagaaggcccgggccgagatggacaaggccaaggcggcctggagcgacaaggtggccgccttccagctgtgcaacgcgcaggaccgggccgtggcgcagtaccaggccagcggcaagggcacccgcacgcaggctggcgcgccgtgcgccgatccgggccccttcgtgccgcccgcgccgcccgcgccggccaccccggccaccccggctcccaagggctga

SEQ ID NO: 7949 - DNA, 348 bp, Ralstonia eutropha JMP134
atgaaacgcatactgatgctgattgccctggccgcaggcaccgctggtctcgccggctcgcaagccgcgctggccaagctgccctcgccgaccgatgcccagaaggccaaggcggaggaaacgaaagcgcgtacggcgtgggccgacaaggtggccgcgttccagctctgcaaggcccaggacaaggttgcggcacggtactacggcgacatgaagaccagcggcaagggcacgcatgagccagtgcagacagctgcctgtgccgacccagggcccttcgtgccgcccgcggcgccagccaccccggccgccgccgcagcagtacaatcgaccgcaaaggcgccttaa

SEQ ID NO: 7950 - DNA, 399 bp, Polaromonas JS666
atgaaaaaactgattcgacttttgacctggggcctgctggcaggtgtgcctgcgctcgcgctggccaagctgccgcccctgaacgacgaggccaaggccaaagctgccgaggccgctgccaagaccgcgtggacgggcaagatcgaggcctaccagctgtgcaaggcgcaggacaaggtggtggccagctattacaaatctgccaagtcggcaggcaaggaaaccaagccgcccgcggcagcgccggcctgcgcggacccgggcgcatttgcctatacgccgccggaggcggccaagcccatcgaggccgcgggcgcgcattctccggcgcctaccgccaccagcccgcccagcaccaagcagcctgatgcggtggccaaccccgctaaaaagccctga

SEQ ID NO: 7951 - DNA, 393 bp, Acidovorax sp. JS42
atgatttttgcagcaactctcgtgcgccgctgcacagcgggtctggcgctggcgtcgttggccggcgtggcagccgccaagctaccacccctgtcgcccgaggcacaggccaaggcggcagagaccgccgccaaggccgcatggtccggcaagatggacgcctataagctgtgtcaggcacaggaccgcgtggtggcgcactaccgccgcaccgcgccgaaccccgcgcctgctgttcctgcccccgcgtgccttgatccgggtcctttcagctacacgccgccggaggccaagccgcttgaggccgcgggtgctcactcgcctgcgggcacggccaccagcccccccaacacggccgtgccggccgccgccgcttcggcccccaagagctga

SEQ ID NO: 7952 - DNA, 396 bp, Polaromonas naphthalenivorans CJ2
atgaccctgaaaaaacttctgaccaccggcctgctgcttggcggctgcgcgctggcagcggccaggctcccgccgccttcacccgaagcgaaggcgaaatctgacgaagctgcggccagggcggcctgggccggcaaggttgatgcctaccagttgtgccagtcgcaggaccgtgcggcggccagctatttcaagtcggcccaggcggcggccaaggaggtcaagccggcgacagccacgccaccgtgcaccgacccgggcgttttcgcgtacacgccggctgaagcggccaagccgctggaagcttcgggcgcccattcaccggccgccacggctaccagcccgcccggcagcaaggtgcccgatgccgtcatgaatcccgataaaaaaccgtga

SEQ ID NO: 7953 - DNA, 429 bp, Methylibium petroleiphilum PM1
atgctgatgatgaaccgacccaccccgggcccgcgctgcgtggccgcggcgctgtgcgccgtgctcggcctggccctgctgccggccgctcacgccaagctccccgcacccacgcccgaagccaaggccaaggccgacgaggccaaggcaaagaccgcctggtccgacaaggtggcggccttccagctctgcaagtcgatggatcgcgtggccgctcgttacgcccaggaggccaaggcggcgggcaaggagaccaagccatcgatcgccacgccggcctgcaccgatcccgggccctaccaggtggccgcgaccgccgccacgccgccgctcgaggccgccggagcgcactcgccggccaagacggcgaccaccccgcccagcggcaaggcgacctcggcagagcagaccgggacgccgaagaagtag

SEQ ID NO: 7954 - DNA, 312 bp, Polynucleobacter necessarius asymbioticus QLW P1DMWA 1
atgaaaaagatcattgcttttgtattttgcgcatttgcaggcacatcagtttttgcaacgctgcctccgttaagccctgaagcgcaagaagcggcgaatttagttaaagctaaaaccgcttatggcgataaggttgcggcatatcaactatgccaggcgcaaaaccgcgttgccgataaatttagagtctctggaacgcctgcgcctgctgcatgtgtagcacctccgccatttgttccgccggtagctgccgcatctgcaccagccgcgcctgctgcaccagcagctgctccagcgactgcagctaaataa

SEQ ID NO: 7955 - DNA, 354 bp, Leptothrix cholodnii SP 6
atgaaccgatacgccatcctgagcgccggcctggtcggcgccttgttcgccgccacggtcagcgccaagctgccgccgcccggcgacgaagccaaggccaaggccgccgaagccgcggccaagaccgcgcacggcggcaaggtcgaggcctggctgctgtgcaagtcgatggaccgggtggccgcggcctacctggcgtcggccaagcaggccggcaaggacgtcaggccgccggtggcgacgccgccctgcgccgatccgggcccgttcgtctacacgccgccggcgcccgtcgcggccgcggcgagcgcgcctgccgtgaccgctgccgcgccggctgcggacaagaagtag

SEQ ID NO: 7956 - DNA, 324 bp, Ralstonia pickettii 12J
atgcatgcttccacgctgactcgcgccgcaggtatggcacttgctgccgccatgctggtcctgacaagcggactggccggcgccaagctgccggcaccgacggaagaacagaaggcacaggcggatctggcgaaggccaaggcagcctggggcgacaaggtggccgcgttccagacgtgcaaggcccaggacaaggcggcggcgtcgtaccaggccggcggcaaggctgcgcatacgcaaccgggcgcgccgtgcgtggatccggggccgtttgtcgcgcctgtgcccgcagcatcggcaccggcaccggcggccaaagggtga

SEQ ID NO: 7957 - DNA, 393 bp, Diaphorobacter TPSY uid29975
atgatttttgcagcaactctcgtgcgccgctgcacagcgggtctggcgctggcgtcgttggccggcgtggcagccgccaagctgccgcccctgtcgcccgaggcacaggccaaggcggcagagaccgccgccaaggccgcatggtccggcaaggtggacgcctataagctgtgtcaggcacaggaccgcgtggtggcgcactaccgccgcaccgcgccgaacgccgcgcctgcggtttctgcccccgcgtgccttgatccgggtcctttcagctacacaccgccggaggccaagccgctagaggccgcgggtgctcactcgcctgcgggcactgccaccagcccccccaacacggccgtgccggccgccgccgcgtctgcccccaagagctga

SEQ ID NO: 7958 - DNA, 414 bp, Variovorax paradoxus S110
atgaagctgccgttgaatctctcttgcgcatcgctgctggtgctcgcgctggcggcgcccgcggcctgggccaagctggcgccgccgcccgccaccccggaggccaaggccaaggccgccgaagccgccgccaagaccgcctggagcggcaaggtcgatgcctacaagctctgccaggcgcaggaccgcgtcgcggccaagtaccgcgcgagcgccaccgcggccggcaagccggtgccgccggcgcctgccactccgccctgcgcagaccccggccccttcgtcttcacgccgccggcggaagccaagcccatcgaggctgcgggcgcgcattcgccggccaccacggccgcatcgccgcccagcaccacgcagccggccgccgccgccaatccgacgccgaaggcgcagtga

SEQ ID NO: 7959 - DNA, 324 bp, Ralstonia pickettii 12D
atgcatgctttcacgctgactcgcgccgcaggtatggcacttgctgccgccatgctgggcctgacaagcggactggccggcgccaagctgccggcaccgacggaagaacagaaggcacaggcggatctggcgaaggccaaggcagcctggggcgacaaggtggccgcgttccagacgtgcaaggcccaagacaaggcggcggcttcctaccaggccggcggtaaggctgcgcatacgcaaccgggcgcgccgtgcgtggatccagggccgtttgtcgcccctgtgcccgcagcaccggcagcggcaccggcggccaaagggtga

SEQ ID NO: 7960 - DNA, 222 bp, Methanosarcina barkeri fusaro
atggctgatgaaaacataaccggcggttttgctgctgaggttattgacgttatcgggaatacaggtatgcatggtgaagccagtcagatccagtgcagggttctggaaggcagggataaaggccgtgtaattacaagaaactgcgtgggcccggtccgcgtaggtgacatcctgatgcttcttgaaacctcaagagaagcaaagaaactgaccaccagataa

SEQ ID NO: 7961 - DNA, 204 bp, Methanospirillum hungatei JF-1
atggacggaacgcccgctgaagtaatcgaggttatcgggtcaaccggtatgcatggagaagccatgcaggtgaaagcccgtatccttgatggcccgaacaaggggcggattatcacccgtaacacggtaggaccgatccgtgaaggtgatgttctgatgctccttgagactgaacgtgaagcaaagaaactttcccggaggtaa

SEQ ID NO: 7962 - DNA, 216 bp, Methanococcoides burtonii DSM 6242
atggcagatgatgatatgggttttgcagctgaggttatcgacgtgatcggtaacaccggtatgcatggcgaagccagccagattcagtgcagggttcttgaaggtcgtgacaagggtaggatcattacaagaaactgcgttggtcctgtaagaattggtgatgttttcatgcttatggagacatccagagaggctaagaaactaactaccaggtga

SEQ ID NO: 7963 - DNA, 213 bp, Methanosaeta thermophila PT
gtggttgaggagaacggcgtccccgcagaagtcatagaagtcataggggtcaccggaatgcacggagaggccacccagataaagtgcaggatactggagggctcgaacaagggcaggatcataaccaggaactgcatgggacctgtgagggttggcgatgtcctgatgcttctggagaccgcgcgcgaggccaagaagctgacaggcaggtga

SEQ ID NO: 7964 - DNA, 234 bp, Pyrobaculum islandicum DSM 4184
atgtcgagtgaggtaaaattttcgccatatgaagacgccgttgcggctctagttatacaaatacttggaagaaccggggtagctggagaggtcacacaagtcaaagtaaaaattctcgaaggccgtgataaaggccgtatcttgactagaaatattaaagggcctgtgagactcggcgacatagtgatgttaagagaaaccgaaagagaagcgcggagaattacggcacgatga

SEQ ID NO: 7965 - DNA, 210 bp, Methanocorpusculum labreanum Z
atgcctgatgatgcaacgccagcagaagttattgaggtcatcggccttaccggaatgcacggagaggcatcccagatcaaatgccgtgtccttgatggctcaaacaaggggcgtatcattacccgtaacactttcggacctatccgtgagggtgacattctgatgctccttgaaacggaacgcgaagcaaagaaactttcccggaggtaa

SEQ ID NO: 7966 - DNA, 210 bp, Methanoculleus marisnigri JR1
atggcaaacgacggaacgcccgcagaagttatcgagatcatcggcatgaccgggatgcatggcgaagcccagcaggtgaagtgccgggttctcgacggcccgaacaaggggcggatcatcacccgcaacacggtgggcccgatcagggagggagacatcctttcgctgctcgagaccgaacgtgaggccaagaagctctcgaggcggtaa

SEQ ID NO: 7967 - DNA, 231 bp, Methanococcus maripaludis C5
atggctgatgatatggtataccaggaagcagtagctgctgaagttatccaaattaacggaagaacaggagttactggtgaaattttccaagtaagatgcaaaatcttaggtggaaaagacacaggaaggatcttaacaagaaacgtaaaagggcctgttaaattaggcgaccttatcatgttaagagaaaccgaaagagaagcaaaacaactcggtaaaagaagaaaataa

SEQ ID NO: 7968 - DNA, 234 bp, Pyrobaculum arsenaticum DSM 13514
atggccgaagaggttaaattctcgccttacgaagacgcagttgccggaatagttatacaaatactaggcagaaccgggatagcgggggaagtcacacaggtaaaggtcaaaatattagaaggcagagacaaggggcgcgtattaacgcggaacatcaaagggcctgtgaggctgggagacattgtaatgcttagggaaacagaaagagaggcgagaagaatctcggcaagatga

SEQ ID NO: 7969 - DNA, 243 bp, Metallosphaera sedula DSM 5348
atgagcgaaaaacaacagtcctcttcaatcattgaggaattcggctttccagctgaggtcattcaattattagacagaactggagtaactggggaggttacacaggtaagggtaagggttcttgaaggaagagacaagggtaggatactaaccagaaatattaagggtccagtgagactgggtgacattgtaattcttagggagacagaaagggaggcaagaaagctaacaaccaagaggtaa

SEQ ID NO: 7970 - DNA, 231 bp, Methanococcus vannielii SB
atggctgatgatatggtataccaggaagcagtagctgctgaagttatccaagtttcaggaagaacaggagttactggagaaattttccaggtaagatgtaaaatcttaggtggaaaagacacaggaagaattttaacaagaaacgttaaaggtcctgttaaagtaggagatctcataatgttgagagaaaccgaaagagaagcaaaacaactcggtaagagaagaaaataa

SEQ ID NO: 7971 - DNA, 228 bp, Methanococcus aeolicus Nankai-3
atgtctgatgacatgatttataaagaagcaatagccgcagaagttcttcaagtaacaggaagaactggtgtgactggggaaattttccaagtaagatgtaaaatcttaggaggaaaagacacaggaagaatattgacaagaaatataaaaggtcctatcaaagtaggagacattattatgctcagagaaaccgaaagagaagcgaaagctctcggaaggagaagatag

SEQ ID NO: 7972 - DNA, 231 bp, Methanococcus maripaludis C7
atggctgatgatatggtataccaggaagcagtggctgctgaagttatccaaatcaacggaagaacaggagttactggtgaaattttccaagtaagatgcaaaatcttaggtggaaaagacacaggaaggatcttaacaagaaacgtgaaaggacctgttaaattaggcgacttcatcatgttaagagaaaccgaaagagaagcaaaacaactcggtaaaagaagaaaataa

SEQ ID NO: 7973 - DNA, 210 bp, Candidatus Methanoregula boonei 6A8
atggctgacgacgcaacgcccgcagaagtcatcgaggttgtcggttccaccggtatgcacggggaagcgatgcaggtcaagtgccgtatcctcgacggcaataacaaagggcgcatcatcacccgcaacacggtcggccccatcagggaaggagatgttatcatgctccttgagaccgaacgcgaagcaaagaaactgtcgaggcggtga

SEQ ID NO: 7974 - DNA, 231 bp, Methanococcus maripaludis C6
atggctgatgatatggtataccaggaagcagtggctgctgaagttatccaaattaacggaagaacaggagttactggtgaaattttccaagtaagatgcaaaatcttaggtggaaaagacacaggaaggatcttaacaagaaacgtgaaaggacctgttaaattaggcgacttcatcatgttaagagaaaccgaaagagaagcaaaacaactcggtaaaagaagaaaataa

SEQ ID NO: 7975 - DNA, 213 bp, Nitrosopumilus maritimus SCM1
atgagcgctacaactgatgaagtagttcactctgaaattattcaaattgttggacgaactggtattgctggtgaagtaattcaagttagagttaaagttcttactggaaaagataaaggtagaattcttacaagaaacgtcaaaggttctgttagattgggagaaattctaatgctaagagaaacagagagagaagcaaagaagatcaaatag

SEQ ID NO: 7976 - DNA, 234 bp, Thermoproteus neutrophilus V24Sta
atggcggaggaggtaaagttctcgccttatgaagacgccgtggcggggctcgtggtccagatactcgggaggacgggagtagcgggggaggtaacacaggtaaaaatcaaggtgcttgaggggagagacaaaggccgcgtgttgacgagaaacgtaaaaggcccagtgagactcggcgacatagtaatgctcagggagacagaaagagaagccaggaggatcacggcaagatga

SEQ ID NO: 7977 - DNA, 225 bp, Halorubrum lacusprofundi ATCC 49239
atgagcgcagaagagggcaccggcgactcgacgaccgcggaggtcatcgaggtcgtcggcaagaccgggatgcacggcgaggccatgcaggtcaagtgccgcatccaggaaggatcgaaccagggccggatcatcacccggaacgtcctgggccccgtccgcatgggcgacgtgctccagctccgggagacccagcgcgatgccgactccatcggagggcgataa

SEQ ID NO: 7978 - DNA, 228 bp, Halorhabdus utahensis DSM 12940
atgagcgctgaggagtccaccgacgacggatccacgcccgcggaggtcatcgaggtcgtgggccggacggggatgcacggcgaggccatgcaggtcaagtgccgcatccgcgagggcgagaacaagggccgaatcatcacccgcaacgtgctcggtggcgtgcgcgagggggacgtcctccagctgcgcgagaccgcacgcgaggcggacgccatcggaggccaataa

SEQ ID NO: 7979 - DNA, 210 bp, Candidatus Methanosphaerula palustris E1 9c
atggcagatgaaggcacgccagcggaagtgatcgaggtgatcgggtccacagggatgcacggagaagccatgcaggtcaaatgccgtatccttgacggttccaacaaggggcggatcatcaccagaaacaccgtcggtccaatccgcgaaggggacatcctgatgctcctcgagaccgaacgtgaagcaaaaaaactctccaggcggtga

SEQ ID NO: 7980 - DNA, 228 bp, Halomicrobium mukohataei DSM 12286
atgagtgctgaggaatccgaagacagtggctccacgccggccgaagtcatcgaggtcgtgggccgtacggggatgcacggcgaggccatgcaggtcaagtgccgcatccgcgagggctcgaaccagggtcggatcatcacccgaaacgtcctcggtcccgtccgagagggcgacgtgctccagctgcgcgagaccgcacgtgaggccgaccagatcggaggtcagtaa

SEQ ID NO: 7981 - DNA, 201 bp, Brucella suis 1330
atgagcgacatcgtcaatcttcgccagttcaaaaagcaaaaagcccgcgacaccaaggaaaagcaggctgagcagaaccggattctttttgggcgaaccaaggttgaaaaggattttgcgcgcgcgcaagcgcagaaagcagagcgctttctggatatgaaccgccgcgaaaccaaagacctccccgaaggcgaaaagtga

SEQ ID NO: 7982 - DNA, 195 bp, Nitrobacter winogradskyi Nb-255
ttggtcatgggggatgtgattaacctgaacaagcgcaggaagcgcgctgaacgcgaacgcgcggccgccgtcgctgacgccaatcgagcgcgcttcggcctcaccaaagccgagcgcgatctttcgaagcagcgaaaggcgcgagaactaagtttgctcgatcaacatcgcatcgacggcgaggacgcatcatga

SEQ ID NO: 7983 - DNA, 189 bp, Rhodopseudomonas palustris HaA2
atggtggatgtggtcaatttgagacgtttcaagaaacgggcggagcgggaagcagccgcgaagctcgccgacgtcaatcgtgcgcgatttggcaggaccaaatcgcagcgtgcgagcgacgagcatcgggtcggtcgcgccaatgaactgctggatcaacatgtaatcggtggcgaggacgcgtcatga

SEQ ID NO: 7984 - DNA, 186 bp, Rhodopseudomonas palustris BisB18
ttggcggatgtgatcaacctgaaacgtttcaagaagcgcacggcgcgtgcgcaatccgctgcggaagcggatgccaatcgcgcccggttcgggcggacaaaggccgaacgcgctttggacgaacgtcgcaccagccgtgcggatgagttattggatcaacatcgaaccaccggggacctgacatga

SEQ ID NO: 7985 - DNA, 189 bp, Rhodopseudomonas palustris BisB5
atggcggatttggtcaatttgaagcgtttcaagaaacgggcagagcgggaagcagccgcgaagcacgccgacgtcaatcgtgcgcggtttggcagaaccaaatcgcagcgcgcaatcgacgatcatcgggtcagccgcgccaatgaactgctcgatcaacacataatcggtggcgaggacgcgtcatga

SEQ ID NO: 7986 - DNA, 204 bp, Nitrobacter hamburgensis X14
atggcggaatcggtcatgggggatgtggtcaatctaagcaagcgcaggaaacgcgccgaacgggaacggacggcagagattgccgacgccaatcgagcgcgctttggccgccccaaggctgagcgcgatctcatcgaacagcgcatgatgcgggagaaacgtctgctcgatcagcaccgcatcgacggcgaggacggatcatga

SEQ ID NO: 7987 - DNA, 204 bp, Rhodobacter sphaeroides 2 4 1
atggccgagatcgtcaaccttcgcgcgaagcgcaaggcggcggagcgcgatgcccgccgccggaagggcgacgagaatgcagcgaagcacggccgcaccagggccgagcgcaggctggaggagacccgggccgaacaggcccgggcgcatctcgagggccaccgccgcgagacggacgcgcccgacgagcccaccgatccatga

SEQ ID NO: 7988 - DNA, 210 bp, Paracoccus denitrificans PD1222
atgaccggagccggatcaggcaaggtcataaacctgcgggcggcgcgcaagaccgccgcccgcgatgccgcccgcaagcagggcgacgagaatgcggcgaagttcggccgcaacaaatcccagaagctcgccgagaaggacgccgccgcgcgtgccgcccgccatctggaccagcatcgccgcgaggatcccgagaatggcgacgaatga

SEQ ID NO: 7989 - DNA, 204 bp, Rhodobacter sphaeroides ATCC 17029
atggccgagatcgtcaaccttcgcgcgaggcgcaaggcggcagagcgcgatgcccgccgccggaagggcgacgagaatgcagcgaagcacggccgcatcaaggccgcgcgcaggctggaggagacccgggccgaacaggcccgggcgcatctcgagggccaccgccgcgagacggacgcgcccgacgagcccaccgatccatga

SEQ ID NO: 7990 - DNA, 204 bp, Rhodobacter sphaeroides ATCC 17025
atggccgagatcgtcaaccttcgcgcgaagcgcaaggcggcggagcgcgacgcccgccgccggaagggcgacgagaacgccgcgaagttcggccgcaccaaggccgagcgcgatctgccggaggcccgggccgagaaggcccgggatcacctcgacgcccacaggcgagagtccgggcgtgagcccgggcccgagccggaatga

SEQ ID NO: 7991 - DNA, 186 bp, Bradyrhizobium BTAi1
atgggggacgtcatcaatctgaagcgtttcaagaagcgcgtcgagcgcgatcaggcggcgcaagcagctgacaccaaccgcgcacgctatggcaggacgaagtccgaacgcgcaactgacgctcaacgcgacaagcgcgcgaatgaattactcgatcaacatcgtatcaatggcgaggacgcgtga

SEQ ID NO: 7992 - DNA, 261 bp, Brucella ovis
ttgcgcaaacgggacgatgcgcgcaatattgcgcaaatctgtcataacaccgtgaccctcatgagcgacatcgtcaatcttcgccagttcaaaaagcaaaaagcccgcgacaccaaggaaaagcaggctgagcagaaccggattctttttgggcgaaccaaggttgaaaaggattttgcgcgcgcgcaagcgcagaaagcagagcgctttctggatatgaaccgccgcgaaaccaaagacctccccgaaggcgaaaagtga

SEQ ID NO: 7993 - DNA, 216 bp, Sinorhizobium medicae WSM419
atgaccggcgacgtgaccaatctgcgccagtttcgcaaacggcaggctcggactgccagagaaaagcaggccgaacagaatcgcctcaccttcggtcgaaccaaggccgagaaatccgtcaccaaagccctgaacgaaaaaaccgcaaagacgctcgatcacgggcggctcgaccgggcgggcgacgacggtgcgcccgatcgcaacaagccgtga

SEQ ID NO: 7994 - DNA, 201 bp, Ochrobactrum anthropi ATCC 49188
atgagcgatatcgtcaatctcagacagttcaaaaagcagaaagcccgcgctgaaaaagaaaagcaggctgaccagaaccgcattcaattcgggcgtacgaagaccgaaaaagctttcgctcgcacggagacgacaaaagcggaacgttttctggatcagaaccgtctggaaaaaaacgataagccggacgggacaaagtga

SEQ ID NO: 7995 - DNA, 189 bp, Methylobacterium extorquens PA1
gtggccgagatcatcaacctgcgccaggtgcgcaaggaccgtgagaaggcggcgaaagaggttaaggccgcggagaaccgcatcctgttcggccggccgaagaaggcgaagacgctggccgagacgcgcaaggcgatcgagcagtcccgccacgagggtcaccgcctcgccgatcccgacaacgaatga

SEQ ID NO: 7996 - DNA, 204 bp, Methylobacterium radiotolerans JCM 2831
atggccgagatcatcaacctgcgtcaggtccgcaaggcgaaggcccgggccgaggccgacacgaaggccgagtccaaccggatcgccttcgggcagcccaagaaggcgaagacgctccagcagcgccgcaaggccctggagaccgagcgccacgagggccaccgcctcgagcggggcgcctccgagcccgataccgcggaatga

SEQ ID NO: 7997 - DNA, 210 bp, Beijerinckia indica ATCC 9039
atgggggaactcgtcaacctgcgccgtgcgcgcaaggacaaggcacggcaggccaaagatgagcgcgccgccgccaatcgcctcctccatggccgcacgcgcgccgagcgcgaaaaactcgatgccgagaaaggtctggccgagcgtcgtctcgatgcgcatctgctcctgaaagatcaggagaagggcactagcgactccagctcctga

SEQ ID NO: 7998 - DNA, 189 bp, Methylobacterium populi BJ001
gtggccgagatcatcaatctgcgccaagtgcgcaaggcccgtgagaaggcggcgaaagagaccaaggccgccgagaaccgaatcctgttcggccgtccgaagaaggcgaagacgcttgccgagacgcgcaaagccctggaacaggcccggcacgaaggtcaccgcctgaccgatcccgacaaggaatga

SEQ ID NO: 7999 - DNA, 189 bp, Rhodopseudomonas palustris TIE 1
atggccgacgtggtcaatttgaaacgcttcaagaagcgagccgagcgggaagcagccgcgaaactcgcagatgccaatcgcgcacgatttggcaggaccaaatcgcagcgagggctcgaccaacatcatgtcagccgcgccaatcaactgctcgatcaacacataatcggtggcgaggacgcgtcatga

SEQ ID NO: 8000 - DNA, 216 bp, Methylobacterium sp. 4-46
atggccgagatcatcaacctgcgccgggcccgcaaggcccgggcccggcagaccgaggaggcgagggcggaggagaaccgcgtcgccttcgggcggccgaaggccgcgcggacgctcgccgagtcccgccgcgcgatcgagaccgcccgccacgagggccaccggctcgagggcccgcccgaggaccggcccggggtgaccgatccgtcggaatga

SEQ ID NO: 8001 - DNA, 195 bp, Rhizobium leguminosarum bv  trifolii WSM2304
atgagcgccgaaatcgttaatctgcgccaattccgcaagaagcaggcccgctccgaaaaggagacgcaggccgagcagaaccgcatttccttcggccgcaccaaggccgaaaagcagctcacccgcagcctgaacgagaaggccgacaaggcccatcgcgacggccgtatcgagaccgatgacgacggcgcctga

SEQ ID NO: 8002 - DNA, 285 bp, Methylocella silvestris BL2
atgcccaatatcgtcaacctgcgactgttccggaagaggcgcgcgcgcgaagacgcagcggacgccgcggagcatgcgcgcgtgagggcagggctcgccaagaccgagcggagcgccgccgaaaggctgtgcgcccaggcgaaactgcggctcgacggtcatctgctggagcatctttcgctcgaaccggttcggtccgacggaggagatccgaccaaggtggtgtgcagccgatccatcggcgcccggacgacgggtccggcggatgacgccgccgcccgatga

SEQ ID NO: 8003 - DNA, 189 bp, Methylobacterium chloromethanicum CM4
gtggccgagatcatcaacctgcgccaggtgcgcaaggaccgtgagaaggtagcgaaagaggccaaggccgcggagaaccgcatcctcttcggccggccgaagaaggcgaagacgctggccgagacgcgcaaggcgatcgagcagtcccgccacgagggtcaccgcctcgctgatcccgacaaggaatga

SEQ ID NO: 8004 - DNA, 192 bp, Methylobacterium nodulans ORS 2060
atggccgagatcgtcaacctgcgccaggcccgcaaggccaaggcacggcaggccaaggaggcggcggcggccgagaaccgggccgccttcggccggcccaggaagaccaggaccctggcggaggcgaggcaggcgatcgagactgcgcgccacgagggccaccgcctcgagggatccggcccgtccgaatga

SEQ ID NO: 8005 - DNA, 213 bp, Agrobacterium vitis S4
atgtcgggcgaagtcgttaatctgcgtcaggtcaggaaagccaaagcgcgcaccgaaaaggaaaagatcgcggatcagaaccgcgtgagtttcgggcgaagcaaggctgagaaaaacctgaccagcgcactgaacgacaaggcccgcgctgctctcgacaattcaaagctggaaccgacaccgaccagtcccgtgcccgacgaacagggctga

SEQ ID NO: 8006 - DNA, 195 bp, Rhizobium leguminosarum bv  trifolii WSM1325
atgagcgccgaaatcatcaatctgcgccagttccgcaagaagcaggctcgctccgaacaggagaagcaggccgaacagaaccgcatctccttcggccgcaccaagggcgaaaagcaactgacccgcagcctgaacgacaaggccgacaaagcccatcgggacggccggatcgagaccgatgacgacggcgcgtga

SEQ ID NO: 8007 - DNA, 555 bp, Rhodopseudomonas palustris BisB18
ttgaagatcatcccgacaccgctggccggctgcgtgctgatcgagcccgacatcatcgcggacgagcgcggttacttcctgcggacgttctgcgcgtcgaccttcgaggcccacggcctcaacccggcgatcgaccaggccagcctatcctacaaccgcgcgcaatacaccctgcgcggcctgcattttcaggcacagccgcacatggaagacaagctggtgcgggtggtgaatggcgcgatcttcgacgtcgcggtggatatccgcaccgattcgaagactttcgccagatggtacgccgccgagctcaccgagcagaaccagcgcgcgctgtatattccgcgagggtttgcccacggctttctgacgctgaccgacgagaccacggtagcctatcagatcgcgcagccttacgtggcgagcctggcgcgcggcgtgaacttcagcgatccgcagatcgccgtgcgctggccgcacccgccttctgtcatcagccagcgcgatcgcgatctgcccgcgctggcggcgatcgatccgacctccgtctcgcagtga

SEQ ID NO: 8008 - DNA, 564 bp, Pelobacter propionicus DSM 2379
atgacttttatacatacaagaatttcaggttgcctcgagatcgttcctgtttgtttccaggacgaacgtggcaggttcgtcaaaacctacaacgaaaaaacgttcgagtcgcacggctgttgcaccgactggaaagaagaattctactcagtttccaggcggggagtgcttcgagggttgcacttccaactccccccccatcagcacgacaagttggtatactgcaccgcgggcacggtactggatgcggtcgtggacctacgaaaaggctctcccacatatggggatcatattatgctcgaactgagtgccgaaaaaggaaacatgctctacatcccccgggggctcgcccatgggttttacgtcaccagcgagtcagccacaatgatgtacaaggtttcttctgtctacgctcctgaccatgatgccggaatccgctgggactctgccggaattgcctggcccgccagcacgccgatcatatccacaaaggatggcctcctcccgcctcttattgacttttcatctcctttttcctttgacgattgtgcgaaaagacaatga

SEQ ID NO: 8009 - DNA, 558 bp, Prochlorococcus marinus MIT 9515
ttgaagatctcagaaacacccatagctggagcatatattctggaaaacgatgtttatagagataatagaggttcttttacttgtttttatattgaggatgattttaaaaaaaataatttgaatactaaatggacacaaataaatagctcactaagttttgatgaaagaacattaagaggtatacattttcagtatcccccctattcccaaataaaactagttagggtaatccaaggatctatttttgatgtaatcgtagatttaaggccgaaatcaaaaacttttggtaaacacttcttttattttttaaatgaaaaaaataataagatgctttatattgcgaatggttttggacatggattcatgacaatggaaaataatacaaagattatctacaacgtatctgcaccctataaaccagagtatgaagaaacaataatatggaatgataaattattaaatattcaatggccaaattctccattaaaattatctgccaaagacttgaatggtaaaacatttaatgaaatcaaactagagattttaaatagagtatga

SEQ ID NO: 8010 - DNA, 582 bp, Methanocorpusculum labreanum Z
atgggaaaattaacgatcatcgaaacaccgctgaaaggcttatacatcgtagaaacgaacgcgttcatagatcaccggggcgcatttgcccgctggttctgtgaagaggaactggcggcagtcctcgggaagcgtcacatcaaaaacgtgaacttttcgagaacggtgaagaaaggttccatcagagggatgcatttccagaagccgccacatgcggagatgaaacttgtgcggtgtatccggggaaggattctggatgtggtcgtggacatccgagcgggatccccgacatttctgcagcactactctgtggagttgtcagcagagaatatgaagatgtttgcagttccggaagggtttgcccatggttttcagtctcttgaagatgattctgagatcatgtatctggtgacggagttttattcgccggaaagcgaagccggacttcggttcagtgatccggcgctgaagatcgagtggccgcttccggtcatggatatttctgaaaaggatggaaaacatccgctggtgaatgataattttgtcggctttgatgtttcgatgtacggggagcaggtatga

SEQ ID NO: 8011 - DNA, 534 bp, Methylobacterium extorquens PA1
gtgatcttcgaggaactcgcgctgcccggcctgttccgcgtcgtgcccgagccgcacgcggacgagcgcggcttcttcgcccgcacccagtgcgagagcgaattcgcggagcgtgggctggtcgggcacttcacgcagtcgagcgtgtcgttcaatcaccgccgcggcaccgtgcgcgggatgcatttttcgaagttgccccacgccgagacgaagctcgtgcgctgcaccgccggcgcgatccacgacgcggtgatcgacctgcggcccgattcgccgacctatctccgcaccacgtcggtcacgctctcggccgcgaaccgccacgccctctacatcccggcgggcctcgcccacggtttccagacgctgagcgacgacgccgagatcctctacatgatcgaccggccgttcgtggcctctgccgcggacggcgtgcgctgggacgatcccgccttcgggctcgtgtggcccgagccggtgacggtcatcgcaccgcgcgacctcgcctttcccgattgggcggggcggtga

SEQ ID NO: 8012 - DNA, 534 bp, Methylobacterium populi BJ001
atgatcttcgaggaactcgcgctgccgggcctgttccgcgtcgcgcccgagccccacgccgacgagcgcggcttcttcgcccgcactcattgcgaggagacgttcaccgcgcgcgggctggtcggacgcttcgcgcagtcgagcgtgtcgttcaaccatcgccgcggcaccgtgcgcgggatgcatttctcaagggcgccccatgccgagacgaagctcgtgcgctgcaccgccggggcgatccacgacgcggtgatcgacctgcggcccgactcgccgacctatcgccgcaccgcggccgtgaggctctcggccgccaaccgccacgccctctacatcccggcaggcctcgcccacggctttcagacgctgagcgacgacgccgagatcctctacatgatcgaccttcccttcgtggcctccgccgccgacggcgtgcgctgggacgaccccgcctttgctctcacctggcccgagccggtgagcgtgatctcggaccgcgaccgcgcctttcccgattgggtgggacggtga

SEQ ID NO: 8013 - DNA, 531 bp, Cyanothece PCC 8801
atgaagttcatttccacaaaactgaatggagcttatctcattgagcttaaaagattagaagatgagcgagggttttttgctcgttcttggtgtcaaaaagaatttctagactatggacttgatgccaacttagtacagtgtaatatatcctttaatcttaaaaagggaacattgcgaggaatgcactaccaaattgctccctatgaagaggtcaaactattacgctgtacccagggcgcgatttatgatgtcatcattgacttaaatcttgaatcgagtagttttaaacaatggataggcgtagaattaagcgcggaaaatcgattaatgatctatattcctaaagggtttgcccacggatttcaaactctagaagatcataccgaagtcttttaccaaatgtctgaattttatcatccagaatgcgctagaggggtgcgatggaacgatccaacttttgctattgaatggcctattgaagacccgattatctcagaaaaagatcgtcaatatgaggattttaaaggttaa

SEQ ID NO: 8014 - DNA, 534 bp, Methylobacterium chloromethanicum CM4
gtgatcttcgaggaactcgcgctgcccagcctgttccgcgtcgtgcccgagccgcacgcggacgagcgcggcttcttcgcccgcacccagtgcgagagcgaattcgcggagcgtgggctggtcgggcacttcacgcagtcgagcgtgtcgttcaatcaccgccgcggcaccgtgcgcgggatgcatttttcgaaattgccccacgccgagacgaagctcgtgcgctgcaccggcggcgcgatccacgacgcggtgatcgacctgcggcccgattcgccgacctatctccgcaccgcgtccgtgacgctctcggccgcgaaccgccatgccctctacattccggcgggccttgcccacggcttccagacgctgagcgacgatgccgagatcctctacatgatcgaccgaccgttcgtggcctccgccgcggacggcgttcgatgggatgatcccgccttcgggctcgcgtggcccgagccggtgaccgtcatcgcaccgcgcgacctcgcctttcccgattggacggggcggtga

SEQ ID NO: 8015 - DNA, 528 bp, Desulfomicrobium baculatum DSM 4028
atgcgcatcctgccgacacccattggcggactccatcagattgaaggggaggcgcatcgtgatgcaaggggcttttttctgcgtacctggtgccgggaggcgtttctggccgctggcatcgatttttttcccgtgcagacgagcctctcggcgaatatccgtcgccatactttgcgcggcatgcattaccaggtttcacccgcccgcgaacgcaagctggtccgctgcctgcacggccgcatccttgatgtggtggtcgatctgcgggacggctcgcccacgcgtttgcggcattgggcggtcaacctgtgttccgatgcgggcaacgccctttttatccccgaaggatgcgcccacggtttcatgaccctgaccgacggggcgctggtcgaatacatgatggacgcgcctcacgccccggagcacgcacgtgggctgcgctgggacgacccggccctggggttgtcgtggccggccagacccgtggtgatttccctgcgtgaccgcagctggcccggccatgtctga

SEQ ID NO: 8016 - DNA, 531 bp, Cyanothece PCC 8802
atgaagttcatttccacaaaactgaatggagcttatctcattgagcttaaaagattagaagatgagcgagggttttttgctcgttcttggtgtcaaaaagaatttctagactatggacttgatgccaacttagtacagtgtaatatatcctttaatcttaaaaagggaacattgcgaggaatgcactaccaaattgctccctatgaagaggtcaaactattacgctgtacccaaggcgcgatttatgatgtcatcattgacttaaatcccaattcgagtagttttaaacaatggataggcgtagaattaagcgcggaaaatcgattaatgatctatattcctaaagggtttgcccacggatttcaaaccctagaagatcataccgaagtcttttaccaaatgtctgaattttatcatccagaatgcgctagaggggtgcgatggaacgatccaacttttgctattgaatggcctattgaagactccattatctcagaaaaagatcgtcaatatgaggattttaaaggttaa

SEQ ID NO: 8017 - DNA, 276 bp, Jannaschia CCS1
atgagcgagccgcgtgagatccgcctgaaacggctgcgcctgcgggcgtggcatcggggcatcaaggaaatggacctgatcctgggcggttgggccgaccggaacctgtcggacgccaccgacgccgatctggatgcgttcgaggcggtgatggccgaggccgatcacgacctttatcagtggatttcgggtcaggcggaggccccgtcggagttgtctgcgatggttgatcgcatcggtgcggacatgcgtcccacgctgggtcggggcgcgtag

SEQ ID NO: 8018 - DNA, 279 bp, Ruegeria sp. TM1040
atgatcgaagcgcaggccaacatcgaagaaagccgcgagacccgtatcaagcgcctgaccatgcgctcgatgcggcgcggtatcaaggaaatggacattctcctgtccggctatgcggccgcgaatctcgcggccatgagtgatgctcaactcgcgctatatgacgcgttgctgcgcgaaaacgaccaggatctttaccaatgggtaacaggtcaaacacccgcgccggaacgctttaacgctctggtcgatgaaatctctagaacataccaaaaataa

SEQ ID NO: 8019 - DNA, 270 bp, Rhodobacter sphaeroides 2 4 1
atgatcgaggcggaggacgcgcggctcaagcgcatgtccatgcggtcgtggcggcgggggaccaaggagatggacctgatcctcgggccctggtcggacgcgcatctggcgggcctctccgaggagcgccttgccctctatgattcgctcttgaacgagaacgaccaggatctcctgccctgggtgctgggtcagcgcgagccgccggcccatctggccgctctgatcgccgagatcggcgccttcgcccggtcccgtctggcccgctga

SEQ ID NO: 8020 - DNA, 246 bp, Paracoccus denitrificans PD1222
atgcgcagctggcggcggggcaccaaggagatggacctgatcctgggccccttctcggacagcgagctggaacggctgaccgaggcggaactggacctttacgaggccctgctgaccgaaaacgaccaggatctgtatccctggatcaccgcccggctgggcgatgcacgcccgggacctcaggccctgctgcccatcctggaccgcgtggcatcctttgcccacgcccgtctggcccggaaatag

SEQ ID NO: 8021 - DNA, 270 bp, Rhodobacter sphaeroides ATCC 17029
atgatcgaggcggaggacgcgcggctcaagcgcatgtccatgcggtcgtggcggcgcgggaccaaggagatggacctgatcctcggtccctggtcggacgcgcatctggcgggcctctccgaggagcgccttgccctctatgattcgctcttgaacgagaacgaccaggatctcctgccctgggtgctgggtcagcgcgagccgccggcccatctggccgctctgatcgccgagatcggcgccttcgcccggacccgtctggcccgctga

SEQ ID NO: 8022 - DNA, 270 bp, Rhodobacter sphaeroides ATCC 17025
atgatcgaggcggacgaggcgcggctcaagcgcatgtccatgcgctcctggcggcgcggcaccaaggagatggacctgatcctcggcccctggtccgacgcccatcttgcgcatctgtcggaggagcgcctggcgctatatgattctcttctgaacgagaatgaccaggatctcctgccctggattctcggccagcgggagccgcctgcgcctctggccgcgctgatctccgagatcggggagttcgcgcgcacgcgactggcccgctga

SEQ ID NO: 8023 - DNA, 300 bp, Dinoroseobacter shibae DFL 12
atgagcgaatttcacctgaccgaagccgccatgggggtcgtcacccccaacgagaccccggaggcccggatcaagcgcatgaagatccgcgcctggcgccgggggatcaaggaaatggacctgatcctcgggccttacgcggacacgcacctcgccgggatgagcgaggccgagctcgacgcgttcgacgcgctgctgaaggaaaacgaccaggatctctatcaatgggtctccgggcaggccgcgccaccggagcggttcgcggcactggtgacgcggttggggcagaccggccgttga

SEQ ID NO: 8024 - DNA, 174 bp, Brucella suis 1330
atgagcaatcatttgggcttcatcatcgcttcctacggcatcacggttgccgcacttgccgtcaccatcggctggatattgattgaccagcgcatccagaaaaacgagctgaagcggcttgaggcgcagggcgtgcgccgccgttctgcaaaagcccccggtaaggcacaatga

SEQ ID NO: 8025 - DNA, 180 bp, Nitrobacter winogradskyi Nb-255
atggcgctcggtccctatgcctcattcatcgtgacatcctacgtgtcggtcgcagccgtggttgtcgcgctcattgtctgggtgatcatggattaccgccgtcagaaggcgcgcctgcgcggccttgaagccgcgggcgcggtcaggcgatcgggacgcagcgcagcggaggttcaatga

SEQ ID NO: 8026 - DNA, 183 bp, Rhodopseudomonas palustris BisB18
gtgatgtcgctcggtccctacgcctctttcatcgtgttgtcctacgcggtgtccgctttggtggtcgcgatcctgatcgtctgggtggcgctggactatcgccggcaacaggccaagctgcgcgcgctcgacgccgccggcgtcagccgccgctccaagcgcaacgccgcggaggcctcatga

SEQ ID NO: 8027 - DNA, 180 bp, Rhodopseudomonas palustris BisB5
gtgatgttcggtcgctacgccgagttcatcgtctcctcttatgcggcgaccgcgatcgtggtcgtgctgctgatcctctgggtggtgatcgattatcgccgccagaaggcgcggctgcgcgacctggaagcgcgcggcgcggtccgccgctccggccgcagcgcaacggatctgtcatga

SEQ ID NO: 8028 - DNA, 180 bp, Nitrobacter hamburgensis X14
atgacgctcggtccctacgcctccttcatcgtcatgtcctatgtcgcggtcgcagccgtggtcgtggcgctcgttatctgggtgatcgtcgattaccgccgtcagaaagcgcgcctgcgcgaccttgaggccgccggcgccgtcaggcggtcgggacgcagcgcggcggagatcaaatga

SEQ ID NO: 8029 - DNA, 162 bp, Mesorhizobium BNC1
atgacacatctcgcctatgtggctgccgcctatgccattgcagcgctggcaatccttgggcttgtcggctggatccttcttgaccagtcagcccagcggagggcgctgaaagaactggaggcgcgcggaatacgccgccgctccaccgggaattcgaaatga

SEQ ID NO: 8030 - DNA, 180 bp, Bradyrhizobium BTAi1
atggacctcggtccctacacctccttcatcgcaacctcctatctcgccgccgcgctcgtcgtggtgctgctgattgcctggatcgcgatcgactaccgcacccagaaggcgcggctgcgcgcgcttgaggagagcggcatcgtcaggcgctcgggccgcgcggcgacggacatccaatga

SEQ ID NO: 8031 - DNA, 174 bp, Brucella ovis; identical to SEQ ID NO: 8024

SEQ ID NO: 8032 - DNA, 177 bp, Sinorhizobium medicae WSM419
atgatgagccatgcgacctatgtcattgcctgctacgcggtctccgccgcgacggtggcggggctcatcttctgggtcctaaccgatggccgtgcccgtaagcgcgagctggagcagctcgaagcggccggcatccgccgccgttcggcggaagcttcgaccggggggggcagatga

SEQ ID NO: 8033 - DNA, 171 bp, Ochrobactrum anthropi ATCC 49188
atgaaccatcttggctatgttctcgcatcctatggcatcacggtcgcggcactcgccgtcaccattggctggatattgatcgatcagcgtatccacaaaaacgaactgaagcggcttgaggcgcagggtgtgcgccgccgttctgcaaaagcctccggtaaagcacaatga

SEQ ID NO: 8034 - DNA, 174 bp, Rhodopseudomonas palustris TIE 1
atgttcggcaaatacgcggacttcatcgtctcatcctacgccgcgaccgcgatcgtggtgctgctgctgatcggctgggtggtgctggattatcgcaagcagaaggcgcggctgcgcgacctcgaagctcgcggcgccgtccgccgctccggccgcagcgccatcgatcactaa

SEQ ID NO: 8035 - DNA, 168 bp, Rhizobium leguminosarum bv  trifolii WSM2304
gtgacgcatgccttctatgtctacgcttcctatggcttcgccgccttcatgacggtcgccgtcacgctctggacctgggccgatggccgggcccgccgccgggaactcgcagcgctcgaagccgccggcatccgccgccgttcggcccgcaaaagggatagcgaatga

SEQ ID NO: 8036 - DNA, 171 bp, Agrobacterium vitis S4
atgaaatatgccttctatatcggcaccgcctatggcctcaccgccgccgccatcctgttcatggtcttctggatctggctggaggggcgcgcgcgtcagaaagaattgaaggcgctggaggcagcaggcatccgccgtcgctccgatccatcgacagaaaaggcgctctga

SEQ ID NO: 8037 - DNA, 180 bp, Rhizobium leguminosarum bv  trifolii WSM1325
gtgacgcatgccttctacgtctacgcttcctatggctttgcagccctggtgacgattgccgtcacggcctggacctgggccgacggccgcgcccgccgcagggaacttgcagcccttgaggctgccggcatccgccgccgttcggcgcgccccaaggacagcgtgggggatggcgaatga

SEQ ID NO: 8038 - DNA, 696 bp, Pseudomonas putida KT2440
atgagccagtccgccaccctgttggtcatcgacgatgaaccgcagatccgcaagttcctgcgtatcagcctggcctcgcaaggctacaaggtgctggaggccgccaccggtgccgaagggttggcccaggcggcactgggcaagccggacctggtggtgctcgacctggggctgccggacatggacggccagcaggtactgcgtgagttgcgcgaatggagtgcagtgccggtgatggtgttgtcggtgcgtgccagtgaagtgcagaaggtcgatgcgctggatggtggtgccaatgactatgtgaccaagccgttcggtatccaggagtttctcgcgcgtgtgcgggcgttgctgcgtcaggtgccacaagccggcggctcggaagtggcagccagctttggtccgctgacggtcgattttgccttccgccgggtgacgctcgacggtgtggaggtggcattgacacgcaaggagtatgctttgctggcgatattggccgggcaccccgggcgggtgattacccagcagcagttgctcaaggatatctgggggccgacccatgcggaggatacccactacctgcgcatcgtggtcgggcatctgcgacagaagctgggcgatgaccccacggcgccgcggttcatcattaccgaggcgggggttggctacaggttggtggcgccgacagcataa

SEQ ID NO: 8039 - DNA, 693 bp, Pseudomonas syringae tomato DC3000
ttgagtcagacggcaaccattctggtgatcgacgacgaaccgcagattcgcaaattcctgcgcatcagccttgtctcgcagggctacaaggttctggaggcggcgaccgggaccgaggggctgacccaggcggcgttgaacaagcctgacttgctggtgctggacctggggctgccggacatggacggtcagcaggtattgagcgagtttcgcgagtggtcggcggtgccggtactggtgctctcggtgcgcgccagcgaagcgcagaaggtccaggcgctggacgccggggccaacgattacgtgaccaagcctttcggcattcaggaatttctggccagggtcagggccttgctcaggcaggtctcgggcagcgacaagcccgagtcggccttgaggttcggtccgctgacggtggatctggcctatcgtcgtgtgctgcttgatgatctggaagtggcattgactcgcaaggagtactcggtgctggcacaattggcccggtatccggggcgggtcatcacccagcagcaactgctcaaggatatctggggtccgacccatgccgaagacagccactacctgcgcatcgtagtcgggcatttgcgccagaaactgggcgatgacccgaccgcgccgaggttcatcatcaccgaggccgggatcggctatcgattgctcgcggacagttga

SEQ ID NO: 8040 - DNA, 705 bp, Geobacter sulfurreducens
atgggccatgaagcgaacgccatcaaccggccgcggatcctgatcgtggacgacgaagcggcgatccgccgctttctccgcaccgtcctcgacgcggaggagttctcgctccaccaggccgaaacgggtcacgccgcgctggccgcagccgcggccatccggcccgatctcatcctcctggatctggggctgccggacctggacggggtggaggtcatcaggcggatcagggagtggtcgccggtgccgatcatcgtgctgtcggtccgggagcgggaggacgacaaggtgcatgccctggatgccggggcggacgactacctgaccaagcccttcggcatcggggaactgctggcgaggatgcgggtggtactgcgccgctccatccggcaggcgcccgaaccgatctgccggatcggcgggcttgaggtggatctgccgcgccgccgcgtgaccgtggacggagtcgaggtacagctcacccccaccgagtacgagctgctgcgcctcctggcggtccacgccggcaaggtcctgacccacagccagatcctccggcagatctggggggttgcccatgtggaacagccccatgtgctgcgggtgaacatcagcaatctccgccgcaagatcgagtccgatcccacgcgcccccgctacctcctgaccgagcccggggtcggctatcgtttgaaggccgagtga

SEQ ID NO: 8041 - DNA, 693 bp, Pseudomonas syringae pv B728a
ttgagccaggcgaccaccattctggtcatcgacgacgagccgcagattcgcaagttcctgcgcatcagtctggcgtcgcagggttacaaggtgctggaagccgccacgggcgccgagggtctgactcaggctgccttgaataaaccggatttgctggtgctcgaccttgggctgccggacatggacggtcagcaggtgctgagcgagtttcgcgagtggtcggcggtgccggtgctggtgctttcggtgcgcgccagtgaggcacagaaagtccaggcgctggacgccggcgccaacgactacgtgaccaagccgtttggcattcaggagtttctggcccgggtcagggcgctgctcaggcaggcgtcgggcagcgataagcccgaatctgcgcttgagttcgggccgctcaccgtcgacctcgcctatcggcgcgtgctgctcgacggtctcgaagtggcgctgacccgcaaggaatacgcggtgctggcgcagttggcgcggcatcccgggcgggtcattacccagcagcaattgctcaaggatatctgggggcctacgcacaccgaagacagtcactatctgcgtatcgtggtggggcatttgcggcagaagctggcagatgatccgaccgctccgcggttcatcctcaccgagcctggaatagggtatcgtctgctcgctgatcactag

SEQ ID NO: 8042 - DNA, 696 bp, Ralstonia eutropha JMP134
atgcctttcgagttttcgcccacggtgctgctcgtcgaggacgaacctcatatccgccgtttcgtgcgtgcggcgctgcaggccgagggctgcacggtgcgcgaggccgattcgctcaagcgcgggctgatcgaggccggcacgcgccagcccgacctggtgatcctcgatcttggcctgcccgacggcgatggcgttgacctgatccgtgaagtgcgcacctggaccgaagtgccggtgctggtgctgtcggcgcgcagtgcagaagaagacaagatcggcgcgctggatgccggcgccgacgactacctgaccaaaccgttcggcgttggcgaactggtggcgcgactgcgcgtgctgctgcgccgccatgcgcggtcgaacccgcacggctctgcgcagatcgcctttggcgaggtgcaagttgacctggccaaccgcatggtcacgcgtgccggagagcccgtgcacctgacgccgatcgaataccgcctgctatcggtgctgatcgcgcatcgcggcaaggtgatgacgcaccgcgagttgctgcgggaggtctggggaccatcgcattccgagagcagccagtacctgcgcgtctacatgggccatctgcgtcacaagctcgaggcagaccctgcgcagccagcgcatctgctcactgaagtcggcgtaggctaccgatttgcagggtag

SEQ ID NO: 8043 - DNA, 693 bp, Rhodopseudomonas palustris HaA2
atgagcgtgaaatcgcgcgtgctggtggtcgacgacgaaccggcgatcctgcgctttctcaagccggcgctggaagccaacggctacgacgtctcgcacgccgcgaccgtcaccgaggcgatcaagcgggtcgccgcggatgcgcccgacattgtgctgctcgatctcggcctcgccgacggcgacggcaaggacgtcatccggcaggtccgcgcctggtcggatctgccgatcctggtcctgtccgcgcgcgagcgcgaagccgagaagatcgagtcgctcgacctcggcgccgacgactacgtcaacaagccgttcaactccggcgaactgatggcgcggatgcgcgcagcgttacgccaccggatgcagcgcaacgccgagcccgccgcgctgtcggtcggcggcatcgagatcgacgcagttcgccaccgcgtcacccgcgacggcgacgagatcaagctgacgccgaaggaattcgaactgctggccttcctggtgcggcacgccggccgcgtcgtcacccaccggcagattctcgcagcggtgtggggaccggcgcacacctcggacacgcaatatctgcgggtctatatcggccagttgcgccagaagatcgaagcgcatgccgacgagccgcggatcatcctgaccgagcccggcatcggctatcggatcggcgacgcaggctga

SEQ ID NO: 8044 - DNA, 693 bp, Nitrobacter hamburgensis X14
gtgagtacgacaaagtctcgtgtgctggtcgtcgatgacgaggcggcgatccttcgtttcctcaagcccgcgctcgaggccaacggctacgacatgtcgagcaccgccaccgtcgcagacgccgtcaagcgcattgccgccgacgctcctgacattgtgctgctcgatctcgggttggccgacggcgacggcaaggatgtgcttcgccgggtgcgtgaatggtccgatgtgccggtgatcgttctctccgcgcgggatcgcgaagccgagaagatcgactcgctcgaccttggcgccgatgactacgtcaacaagcctttcaacgtcggcgaactgatggcgcggatgcgtaccgcgcttcggcaccgcctgcagcgcaacgcggagacgccatcgctgcgagctggcgatctcgaagtggatgtcgtgcggcaccgcgcgatgcgcgcaggagtcgaattgaagctgacgccaaaggaattcgagctgctgtcgttccttgcgaaaaatgccggccgggtcttgacccatcggcaaatccttgcagccgtgtggggggtcgcgcacaccgcagatacgcagtacctgcgcgtctatatcggccagttgcggcagaaaatcgaagacaaagccgatgatccacggatcatcctgaccgagccgggcattgggtatcgtatcagtgaaagctaa

SEQ ID NO: 8045 - DNA, 696 bp, Cupriavidus metallidurans CH34 uid250
atgccttttgattattcgccgaccgtgttgctggtcgaggacgaaccccacatccgccgcttcgtgcgtgaatcgctgcagtccgagggctgcacggtgcacgaggccgatacgctcaagcgcggcctgattgacgccggcacgcgccagccggatgtggtgatcctggaccttggcctgcctgatggcgatggcatgacactgatccgcgagatgcgcacctggaccgaggtgcctgtgctggtgctatcggcacgcactggcgaagccgacaagatcgccgcgctcgatgcgggcgcggacgactacctgaccaagccgttcggcgtcggtgaactggtggcgcgcgtgcgcgtgctgctgcgccggcacgccaaggcgaatccacaaggcacgccccagatcacgttcggcgacgtgcgcgtggacctggccaaccggctcgtcacgcgcggcgaagatcaggtgcatctgacgccgatcgaataccgcctgctggccgtgctgatcgccaatcgtggcaaggtcatgacgcaccgggaactgctgcgcgaggtctggggcccctcgcactcggagagcagccactacctgcgggtctatatgggccacctgcgccacaagctcgaggtcgatccggcccagcccgcgcatctgctgacagaggtgggcgtcggataccggttcgccggctga

SEQ ID NO: 8046 - DNA, 693 bp, Pseudomonas aeruginosa UCBPP-PA14
atgacccaattgcagaacagcatcctgctgatcgacgacgaaccgcagatccgcaagttcctccgtatcagcctcaatgcccagggctaccgggtactcgaggccggcaccggcgaagaggggctggcccaggccgcgctgaaccggccggacctggtggtgctcgacctcggcctgccggaccgcgacggccaggacatcctccgcgacctgcgcgaatggtcgcaggtgccggtgctggtgctgtcggtgcgcgccagcgagggcgagaaggtgctggccctggacggtggcgccaacgactacgtgaccaagccgttcggcatccaggagttcctcgcccgcgtgcgcgtcctgctgcgccaggcggcgcagggcgaaagcccggaggcggcggtggcggtcggcccgttgcaggtggacttcgcctatcgccgggtcaccctggagggtgcggaagtggcgctgacgcgtaaggagtacgcggtgctcgccgcgctggcacgccatctcggacgggtagtgacccagcagcaactgctcaaggatatctggggcccgacccacgtcgaagacacccattacctgcgggtcgtggtcggccacctgcggcagaaactcggcgacgatccggccagcccgcgcttcctggtgaccgaggcgggcgtcggctatcgcctgcgcgacagctga

SEQ ID NO: 8047 - DNA, 708 bp, Polaromonas naphthalenivorans CJ2
atggtcactcccgttgttgtcatcatcgaagacgagccgcagatccgccgttttgtccgcagtgcgctggaagccgagggctggcaggtgttcgaggccggcacggccaggcaaggcttgaccgaagccggcacgcgcaagcccgacctgctggtgcttgacctgggcttgcccgacggcgacgggctggatgtgatccgcgacgtgcgcggctggtcaggcgttcccatcatcgtgctgtcggcgcgcagcggcgaagccgacaagattgccgcgctcgacgccggcgccgacgactacctgaccaagcccttcggcgtcggcgaactgctggcccgcgtgcgcgccaacctgcgccggccgcgcgccgccgccaccgacggtactccggcggaagaggctgacccggtgtttcgcttcggcgcggtcgaggtggaccggcgggcgcggctggtgcgccgcgctggcgcggaagtccacctgacgcccatcgaataccgcctgctcagcgtgctgatcgccaacgccggccgggtgctgacgcaccgccagctgctgcgcgaggtgtgggggccgtcgcatgccgggcaaagccactacctgcgcatctacatgggccacctgcggcaaaagctggaacctgacccggcccagccgcagcacctgctgaccgaaaccgccgtgggctaccggctggtcgtgacctga

SEQ ID NO: 8048 - DNA, 690 bp, Serratia proteamaculans 568
gtgagcaacacgccaaccaatattctgattgttgaagatgaaaaagagatccggcgtttcgtccgtaccgccctggaaagtgaaggcctgcgggtgtttgaaagcgaaacgctgcaacgcgggctgattgaagccggcacgcgtaaaccggatctgattattctcgatttggggttgccggacggcgacgggcttaactatatccgcgatttacgccaatggagcgccattccggtgatcgtgttgtcggcacgcaacgctgaggaagacaaaatcgccgcgctggacgccggggcggatgactatctcagcaagccatttggtattggcgaattgctggcgcgcgtgcgggtcgcgttgcgacgtcattccggtagcctgcaggaaagcccgttggtcagcttctcagaaatcaccgtagatctgattaatcgccgggtgctgcgccagggggaagatttgcatctgacgccaatagagtttcgactgctggccgagttgctggccaactccggcaaggtgttgacccagcggcagcttcttagccacgtgtgggggccgaactacgtcgaacacagccattatctgcgaatttatatgggccatctgcggcagaaactggaggccgacccggcccggccaaaacacttgctgaccgaaaccggcgtcggttaccgctttatgccttga

SEQ ID NO: 8049 - DNA, 696 bp, Pseudomonas putida GB 1
atgagccagtccgccacgctgttggtcatcgacgatgaaccgcagatccgcaagttcctgcgcatcagcctggcttcgcaaggctacaaagtgctcgaagctgctaccggcgaggaagggctggcccaggcagctttgggcaagccggacctggtggtgctcgaccttgggctgccggacatggacggccagcaggtgctgcgtgagctgcgcgagtggagcgcggtgccggtgatggtgttgtcggtgcgtgccagtgaagtgcaaaaggtggatgcgctggacggcggcgccaatgactatgtgaccaagccgttcggcatccaggagtttctcgcgcgggtacgggccttgctgcgccaggtgccacaggccggcggctcggaggtggcggcgagctttgggccgctgaccgtggacttcgcctttcgccgggtgactattgacggtgtggaagtggcgttgacgcgcaaggagtatgccttgctggcgctgttggccgggcaccctgggcgggtgatcacccagcagcaactgctcaaggatatctgggggccgacgcatgtggaggacactcattacttgcggatcgtcgtagggcatttacggcagaagctgggggatgaccccacggcgccaaggtttatcatcaccgaagcgggagtggggtacaggttggtggcgccgaccgcataa

SEQ ID NO: 8050 - DNA, 699 bp, Azotobacter vinelandii DJ
atgagcggcgtgcagcaaagcatcctggtgatcgacgacgaggcgcagatccgcaagttcctgcgcatcagcctcgtcgcccacggttaccgggtactggaggccggctgcggtcgcgaggggctgacgctggcggccgaggcgcggcccgatctgctggtgctcgatctggggctgccggacatggacggcaaggaactgctcgccgaactgcggcgcgactcccaggtgccggtgctggtgctttcggtacgtgccggcgacggcgagaaggtactggcgctggacggcggcgccaacgactacgtgaccaagcccttcagcatccgtgagctgctcgcccgggtgcgcgtgctgctgcgccggccggcttcgcccggacaggggccgggcacgctgaactgcggcccgctggcggtggatctggacaaccggcgggtcgacctcgacggccgggaaatcgccctgacgcgcaaggagtacgacgtgctggccatgctcgcccgccatccggggcgcatcgtcacccagcagcagttgctcagggatatctgggggccgacccatgtcgaggacagccattacctgcgggtggtggtcggtcacctgcgccagaagctcggcgacgatcccgccgatccccgtttcatcgtcaccgaggcgggcatcggttaccgcctgcgcgagcaggccccgtga

SEQ ID NO: 8051 - DNA, 693 bp, Variovorax paradoxus S110
atgccatcgcccaccgccatcgtgatcgaggacgagccgcagatccgccgcttcgtgcgcggcgcgctcgaggccgagggctggctggtgcacgaggccggcacgctgcgcgagggcctggcggcggccggcacgcgccagcccgacctgctggtgctcgacctcggcctgcccgatggcgacggcgtgtcgctgatccgcgatgtgcgcggctggtcggccgtgccgatcatcgtgctgtccgcgcgcagcgacgaggccgacaagatcgccgcgctcgatgccggcgccgacgactacctgaccaagcccttcggcaccggcgaactgctcgcgcgcgtgcgcgccaacctgcgccggccacgcgcggcgggcggcgacgaagcggcagaagcggtgttccgcttcggcgaggtcgagctggaccgcgccgcgcgcatcgtgcgccgggccggcgccgaggtgcatctgacgccgaccgagtaccggttgctgtcagtgctcgtcgccaacgccggccgcgtgctcacgcagcgccagcttctgcgcgaggtgtgggggccgtcgcacacggaccagagccactatctgcgcatctacatggggcatctgcggcagaagctggaagcggatccggcgcagccgcggcatttgttgacggagactgcggtggggtatcggctggtggtttag

SEQ ID NO: 8052 - DNA, 345 bp, Jannaschia CCS1
gtgaaggcctacgcaaatcgcgcccatcccctgtggctggcctacatcctgcaccggctctcggggctgtttctggcgctgttcctgcccctgcatttctggatcctcgccatggcgatgaccgaccccacccgcttcgacggcttcatcgccttcacggaaatcggcgtggtgaagctggccgaattcggcctcgtcttcctgctggcggttcacatgttcggcggcctgcgcctgatggcgatggaatggctaccgtggagcggaccgcaaaagacgctcgccgcaggcgccaccgccgcgtccttcttcatcgcaacccttttcttcatgcaggccatctga

SEQ ID NO: 8053 - DNA, 345 bp, Rhodobacter sphaeroides 2 4 1
atgatctcgctcgcccaccgctcgcaccctctgtggctcgcctatctcgtccaccgcctctcggggctcggcctcgcgctgttcctgcccgtgcatttctacatgctggccatggtgctgaccgaccccgaggggttcgacagcttcggactctggacccagaaccccctggtgaagatggccgagttcggcctcgtcttcctcctcgccgcccatttcttcggcggcctccggcttctcgcgctcgagatgctgccctggagcgggcggcagaagacgctggccgccgccaccgtcgccggcgccttcctcgtggccgcgaccttccttctgagggcgatctga

SEQ ID NO: 8054 - DNA, 351 bp, Verminephrobacter eiseniae EF01-2
atgaggtcgccgcgcaaccaccgggcctattgggcctttctcgggcatcgcatctcgggcctggcgctggggctgttcctgccggcccacctttatgtcctgggtctggcattggaggaaagccggcgcctggagcaatttctgaagttcgcggagctgggcgccgtcaagttcggcgaatggggcctggtcattttgctgtcggtccacatgtgctttggcctgcgcctgctggcgctggagttgctgccctggagcagcagccgcgatgcgcggctgtcatggatcacctggggcgcggtgctctctgccgtggtcggtgtggtgttggccgtcagggtgatgcgatga

SEQ ID NO: 8055 - DNA, 345 bp, Rhodobacter sphaeroides ATCC 17029
atgatctcgctcgcgcaccgctcgcacccgctctggctcgcctatctcgtccaccgcctctcggggctcggcctcgcgctgttcctgcccgtgcatttctacatgctggccatggtgctgaccgaccccgaggggttcgacagtttcgggctctggacccagaacccgctggtgaagatggccgagttcggcctcgtcttcctcctcgccgcccatttcttcggcggcctccggcttctcgcgctcgagatgctgccctggagcgggcggcagaagacgctggccgccgccaccgtcgccggcgcattcctcgtggccgcgaccttccttctgagggcgatctga

SEQ ID NO: 8056 - DNA, 378 bp, Methylobacterium radiotolerans JCM 2831
atgatgaccgccgcgagcacggccgggcggaccggcatcacccgcgcgtccctgcgcaggcccggcttcgccgccgcgctgatccaccggctgtcggggatcgccctggcgctgttcctgccgatgcacttcatcgcgctcggcaccgcgctccagggcgccgaccggctggagcgcttcctcggcctcacccataacggcttcgtccgcacggccgaatggggcctcgtctgcgcgctcgccgtccacatggcgctgggactgcgcgtactcgccatcgagtggctgcgcttccgcgagcgcaacgcccgcgtcgtgtcgggctgtctcgcgaccgccttcgcgatcggcctcctgttcctcctcagcggggcctga

SEQ ID NO: 8057 - DNA, 348 bp, Methylobacterium nodulans ORS 2060
atgagtgcgcctcgctcctactgccggaacgccctctggatcgccgccatggtgcaccggatctccgggctcggtctcgcggccttcctgccgttccacttcctcgccctcggtctctcgctgcagggcgcctccgaactggacggctttctgcactggacggacaccccggtcgtgaagatcgccgaaggcggcttggtcttcctgctcgccgtccatttcttggggggattgcgcgttctattcgtggagaacttcgactggcgcgtcaatcaactgaggctggcatcggctgccggcgcaactgccgccgtgatcgccttcgccttcctcgtgcgggttctgtga

SEQ ID NO: 8058 - DNA, 345 bp, Variovorax paradoxus S110
atgaagaccgctcgcagccatcaagcgtactgggccttcctaggacatcgcctctcgggcctggcgcttgcactcttcctgcccgtccacttctatgtgctcggcatggccctggacgaagcacgcctcgaccgcttcctgaagctgtcggagatgcctgcgatgaagttcggcgagtggggactcgtcctgttgctgacactgcacatgttccttggattgcgtctgctcgcactcgagctgcttccctggagctccacgcgcgacgctcgcctggcctggattggctggggttttgcggcatcgatggcatttggctttgcgttcatcgcgggagtgatttga

SEQ ID NO: 8059 - DNA, 303 bp, Methylococcus capsulatus Bath
gtgctgtatgccatactttgcgaagatcgccccggcagtctcgagatgcggaagggagcccgcccggctcatttgcagcggctcgaccggttgcaggacgaaggccggctggtgctggcggggccgcatccggcgatcgactgcgaggatccgggtgaggccgggttcaccggcagcctgatcgtcgcggaatttccgagcctggaagacgcgcaacgctgggcagacgaagatccttacggtcgcgctggcgtctatgcccgcgtggtggtcaaaccttttcggcaggtatacccgaaatga

SEQ ID NO: 8060 - DNA, 303 bp, Dechloromonas aromatica RCB
atgctctatgcgatcattgctgaagacaaggccggcacgctggacaagcgcctcgccgcccgtcctgcccacctggagcgcctgctggccttgcaatccgaagctcgcctgatcctggccggcccctgtccggccatcgattcgcccgacccgggcccagccggcttttcaggcagcatcatcatcgccgaattcggctcgctgactgcggcccaaacctgggccgatgccgatccctatatcgcggccggtgtttacgagaaagtcaccatcaagccattcaagaaggcactgccggcgtga

SEQ ID NO: 8061 - DNA, 303 bp, Thiobacillus denitrificans ATCC 25259
atgttttacgcgatagtcggacaggacgcggaagggagtctcaccaagcgcgcggccgcccgccccgctcaccttgagcgcctgcagcgtttgcaggacgaaggccgcctgctgctcgccggccccttccctgcgatcgatgccctcgaccccggcgcggccggcttctccggcagcctcatcgtcgccgagttcggcacgctcgacgacgcgcaggcctgggcgagcgccgacccgtacgtcgcggcgggcgtctacagcgaggtcagcgtcaagcccttcaagaaagtcctgccggcatga

SEQ ID NO: 8062 - DNA, 300 bp, Nitrosococcus oceani ATCC 19707
atgctctatgcaattattggtcaagatattgaccatagcctggaacgccgccgccaggtccgctccgagcacttggcgcgaatccggaaactccaagaaaatggccacctggtactagcaggtccttttcccgctctggatactcaggaccctggagaagcaggctttaccggcagtctcatcgtggcggaattttcctccctggaagcagcccaacaatgggccgaagctgatccttatgtagaagcgggagtctatgcccaggtcaccgtcaaacccttcaaacaggtgctgccgtga

SEQ ID NO: 8063 - DNA, 306 bp, Nitrosospira multiformis ATCC 25196
atgatgctatatgctataagtggcgaggatgtgcctgacagtcttgacaaaagaatggcggtacgtcctgcacacctggaacgcatcaaagcgttgcaggaagacggccgccttgttttagccggtccctatcccgcgattgacagtccagatcccggaccggcgggattttccggaagtctgatcgtagccgagttcgagtcgcttgaagcagcccaggcctgggcggaagcggatccctacgccacttcgggtgtctatgcgaaagtgacggtgaagccgttcaaaaaggttttaccggcataa

SEQ ID NO: 8064 - DNA, 303 bp, Methylobacillus flagellatus KT
atgtggtataccatcattgcagaagacgttcccggcagcctggaaaaacgcctggctgcccgccctccccaccttgagcgcctgaaggctcttcaggatgcaggtcgcctcctgctggctggcccctttcccgcgatcgacagcaatgatccgggtcctgcaggattcaccggcagcctgattgtggccgagtttgacagtctggaatcggcgcaggcctgggccaatgaggatccatttgtgaacgcaggggtatattccgctgtcacagtcaaaccttttcgcaaaaccttgcctgcatga

SEQ ID NO: 8065 - DNA, 300 bp, Alkalilimnicola ehrlichei MLHE-1
atgtattacgccatcatcagcgaggacgtgcccaacagcctgcccttgcgcaaagaggcccggcccgcccacctggcacggctggaggccctaagggacgagggccggctgctgatcgccggcccccacccggccatcgacgccgaggatccgggcgaggcgggtttctccggcagcctggtggtcgcggagtttcccagcctggaggcggcaaaggcgtgggccaatgccgacccctacctggatgtgggtgcctacgaaagggtcaccgtcaagccgttcaagaaggtgttgccgtga

SEQ ID NO: 8066 - DNA, 261 bp, Xanthomonas oryzae PXO99A
ttggctgcacggcagcaggcgcggccggcgcatctggcgcgtttgcaggcgcttgcggccgccggtcggttgctggtggcgggcccgtgcccggccatcgatgccgaagatccgggcccgtccggtttcagcggcagcgtggtgattgccgaattcgacgcgctggaagatgcgcgcgcctgggccaatgccgacccgtacgtggaagcgggtgtgtatgcgcgcaccgaggtccgcccgttccgccgggtgttgccatga

SEQ ID NO: 8067 - DNA, 300 bp, Stenotrophomonas maltophilia R551 3
gtgtggtatgtgattgaagggtatgacggccaggatgtcctggcacaacggctgcaggcccggccggaacacctggcgcgcctgcacgcgctgcgcgacgagggtcgcctgctgttggccgggccgtgcccggcggtggacagcgaagacccgggcccggccggattcagtggctcggtggtgattgcccagttcgattcgttgccgcaggcgcaggcctgggccgatgccgacccgtacgtggcggcaggtgtctacacccatgtgcaggtgcgaccgttccgcaaggtgctgccgtga

SEQ ID NO: 8068 - DNA, 303 bp, Acidithiobacillus ferrooxidans ATCC 53993
atgtattactgcattattggcacggacaatgccgactctctgggcaaacgccaggcggcgcgaggcgatcatctggcgcgcctgcatcagttgcaatccgaggggcgcttactgactgcgggcccatttcccgccatagacagtgaagaaccgggcgaagcagggtttaccggcagcctgatcattgcccgttttgactcgttggaagatgcccatacctgggctgccgccgaaccttatctcagtgccggtgtttacgcagatgtcagcgttcgcccttataaaggagtatttttgccatga

SEQ ID NO: 8069 - DNA, 300 bp, Thauera sp. MZ1T
atgctctacgccctgatcggagaggacgctcccggcgcgctcgagacgcgcctcgcggtgcgcccgcaacatgtcgcccgcctcgaggcattgcgcgacgacggccgcctgttgctggccgggccgatgcccgcgatcgactcgcccgaccccggcccggcgggcttcgccggcagcctgatcgtcgccgagttcgactcgctcgccagcgccgaggcctggcttcgggacgacccctacgtgcgccagggcgtgttcgtacggaccaccgtgcgcccgttccggaagacgctgccgtga

SEQ ID NO: 8070 - DNA, 330 bp, Acidithiobacillus ferrooxidans ATCC 23270
atgcatctcaccaacaggaaaaggttcatgtattactgcattattggcacggacaatgccgactctctgggcaaacgccaggcggcgcgaggcgatcatctggcgcgcctgcatcagttgcaatccgaggggcgcttactgactgcgggcccatttcccgccatagacagtgaagaaccgggcgaagcagggtttaccggcagcctgatcattgcccgttttgactcgttggaagatgcccatacctgggctgccgccgaaccttatctcagtgccggtgtttacgcagatgtcagcgttcgcccttataaaggagtatttttgccatga

SEQ ID NO: 8071 - DNA, 210 bp, Pseudomonas syringae tomato DC3000
atggaagacaccgacctgcaagcgctgatgaaacgtgtggagctgctcctgaagtacgccgagcaacttaaaggccaaaacgcactcctattagctcaggaaaagacctggcgcgaggaacgcgcccaactcattgaaaaaaacgaaatcgcccggcagaaggtcgagtcaatgatttcgcgcctcaaagccctggagcaagactcatga

SEQ ID NO: 8072 - DNA, 210 bp, Pseudomonas syringae pv B728a
atggaagacaccgacctgcaagcgctgatgaaacgtgtggagctgctcctgaagtatgccgagcaacttaaaggccaaaacgcactcttattagctcaggaaaagacctggcgcgaggaacgtgcccaactgattgaaaaaaacgaaatcgcccggcagaaggtcgagtcaatgatttcgcgccttaaagccctggagcaagactcatga

SEQ ID NO: 8073 - DNA, 210 bp, Nitrosococcus oceani ATCC 19707
atggtagagaatatggttaagcaattagagcggcgaattgaggaactcatcgatctatgtaatcaccttagggaagaaaaccagcttctgcgggagcagaacgcggatctcatttctgaaagggcaaaactgattgagcaaaccgaacttgcacgaagccgggtcgaggggatgatcacacgcctcaaatctatggagcaggcatcatga

SEQ ID NO: 8074 - DNA, 210 bp, Saccharophagus degradans 2-40
atgtcgaacatagcaatggagcaagttgaagctaaactcgatgagttaattggcttgtgtacgcgcttagaaaaagagaacgccacgctgcgcgcaaaggaagacagctggcagcaggagcgtttgcgcttactggaaaaaaacgaaatcgcgcgcaagcgcgtagaagccatgattgagcggcttaaaaaaattcatactgaagcataa

SEQ ID NO: 8075 - DNA, 216 bp, Alkalilimnicola ehrlichei MLHE-1
gtggctgattccgttaccgaagagctggtgcggcttgagcagcgcgtggaggcgctgctgaaggccgacgcccggctcagggaagaaaaccgggtgctgcgccagtccctggagcagctcaatgccgagcgtgccagcctgaaggagaagaacgacctggcccgctcacagatcgaggccatgatcagccgtctgcgcgccatggagcacggttga

SEQ ID NO: 8076 - DNA, 312 bp, Pseudomonas aeruginosa UCBPP-PA14
atgcgaccggttgccggcgcgccggcccggccggggcattggccccgaccggggacgatcctatatagttgtccaatcaccccaattcccaagcgagagcccatggaagacgccgatctgcaattgttgacggccaagttcgaccagctgctccagaagctggaacagctcaaggcggagaaccggctgctgcgggcgaacgaaaagtcctggcgcgaagagcgcgctcatctgatcgaaaagaacgaaatggcgagacacaaggtcgaagcgatgattttgcgtctgaaagccttggagcaggacacatga

SEQ ID NO: 8077 - DNA, 213 bp, Halorhodospira halophila SL1
gtgtctgattactcggtcgaagagctggtgcgtctggagcagcgcatcgagcagctgctgcgccagcacgagcgcctgcgcgaggaaaaccgcctgcttcgcgaggcgcaggagcagctccaggcggatcgggcggcgcttcaggaaaagaacgaactcgcccgttcccagatcgagtcgatgatcagccggctcaaggcgatggagcagtag

SEQ ID NO: 8078 - DNA, 207 bp, Marinobacter aquaeolei VT8
atggaacagtccgaagtacaggcattagcggacaagctggacaagctgatcgagcgctgcgacaagctggagaaagacaacgccctgctaagggagctgcaggacgactggaaccgggaacgggcccagctaatgcacaaaaacgatcttgcaaaaaacaagattgaagccatgatcggccgtcttcgggcactggagcaccactga

SEQ ID NO: 8079 - DNA, 210 bp, Pseudomonas mendocina ymp
atggaagacgccgatctgcacgtattgaccgccaagctggaactgctgatccagcgtgtcgagcagctcaaggctcacaaccgactcctgctggcgaatgaacaggcctggcgcgaggaacgcgcccatctgatcgaaaagaacgaattggcccggcacaaggtcgaatcgatgatttcgcgcctcaaagccctggagcaggacacatga

SEQ ID NO: 8080 - DNA, 219 bp, Pseudomonas putida F1
gtgcaacccacgcaagagaacgacctgcaggcactgatgagccgattcgagttgctgatcgaacgcgtcgagcaactaaaacggcaaaatgcactcctagtagctcaggaaaaatcctggcgcgaagagcgcgcccacctcatcgaaaagaacgagatcgccaagcgcaaagtcgagtcgatgattttacgcctcaaggctctggagcaagactcatga

SEQ ID NO: 8081 - DNA, 210 bp, Pseudomonas aeruginosa PA7
atggaagacgccgatctgcaactgttgacggccaagttcgaccagctgctccagaagctggaacagctcaaggcggagaaccggctgctgcgggcgaacgaaaagtcctggcgcgaagagcgcgctcatctgatcgaaaagaacgaaatggcgagacacaaggtcgaagcgatgattttgcgtctgaaagccttggagcaggacacatga

SEQ ID NO: 8082 - DNA, 213 bp, Coxiella burnetii RSA 331
atgcaacctacacatacgctagaactcagcgagttagaatatcaagttgatcatttattgcgttctttagaacgattgaaatcggaaaacaatgccttgcgtcaaaaattagccactcaagtccgggagcgttcattattggttgaaaaaaaccttcaagccgcccagaaaattaaaaaagtaattacacaattaagggaagaaatgccatga

SEQ ID NO: 8083 - DNA, 219 bp, Pseudomonas putida GB 1
gtgcaacccacgcaagagaacgacctgcaggcactgatgagccgattcgagttgctgatcgaacgcgtcgagcaactaaaacggcaaaatgcactcctattagcgcaggaaaaatcctggcgcgaagagcgcgcccacctcatcgaaaaaaacgagatcgccaagcgcaaagtcgagtcgatgattttacgcctcaaggctctggagcaagactcatga

SEQ ID NO: 8084 - DNA, 219 bp, Pseudomonas putida W619
gtgcaacccacgcaagagaacgacctgcaagcattgatgagccggttcgagtcgctgatcgagcgcgtcgagcaacttaaacggcaaaatgcactcctagtagctcaggaaaaatcctggcgcgaagagcgcgcccacctcatcgaaaagaacgagatcgccaagcgcaaggtcgagtcgatgatcttacgcctcaaggccctggagcaagactcatga

SEQ ID NO: 8085 - DNA, 222 bp, Xylella fastidiosa M12
atggatcagcctgatgccctcaccgaactccactctctagcagcgcagctagagaggctgatcgaatactgtcaacgtttagctgaggaaaatcacaatttgcgctgccagcagcatcagatgatgctggaacgtcgcgaacttctagcaaaaaacgaacaagcacgctcgcgcgtggaagcaatgattacacgtcttaagaccctggagcagcacacatga

SEQ ID NO: 8086 - DNA, 222 bp, Xylella fastidiosa M23
atggatcagcctgatgccctcaccgaactccactctctagcagcgcagctagagaggctgatcgaatactgtcaacgtttagctgaggaaaatcacaatttgcgctgccagcatcatcagatgatgcttgaacgtcgcgaacttctagcaaaaaacgaacaagcacgctcgcgcgttgaagcaatgattacacgtcttaagaccctggagcagcacacgtga

SEQ ID NO: 8087 - DNA, 270 bp, Xanthomonas oryzae PXO99A
gtgcgcgcgcgcttgaccaccccgcgcgcgcgcgcctatcgtgagcgcatggacaacgctgccgccctcgctcagatccgcgcacttgccgcccgcgtggaggccttggtggagcgtacccaacggctgaccgacgaaaaccgcagcctgcgtcaccaacaggaacagctcatcggcgagcgctcgcaactgttgaccaagaacgagcaggcgcgctcgcgtgtggaagcgatgatcgcccacttgaagtcactggagcagcacacgtga

SEQ ID NO: 8088 - DNA, 222 bp, Stenotrophomonas maltophilia R551 3
atggaacccgccgatccccttgcccagctgcaggacttcgccgcccgcgtggaagcgttgcttgaacgcaaccagcggctggccgaggagaaccgcagcctgcgccatcagcaggaacaactggtggccgagcgctccacgctgctggccaagaacgaacaggcgcgctcgcgggtggaagcaatgatcagccggctcaaatccctggagcagcacacatga

SEQ ID NO: 8089 - DNA, 234 bp, Thioalkalivibrio HL EbGR7
atggacacgatcaatacacaggacatcgccgaacaggagctcaggaaacttgaggtccgtgtgggtgaactcatccgcacctgcgagcggctcaaagaggaaaaccgcctcctgcgcgagcagcaggtcaacctcgccgccgagcgatcctccctggtggaaggacaggaagcggcgcgtctgaaggtggaggcgatgatcgcccgcctgaagtccatggagcagtccgcgtga

SEQ ID NO: 8090 - DNA, 210 bp, Azotobacter vinelandii DJ
atggaagacgacgacctgaaagcccttgcccgtcagttggaactgttgatccagcgtctcgagcagatcaaggcccacaaccggtttctcctggcgaatgaaaaagcctggcgggaagagcgcgcccacctcatcgaaaagaacgaaatcgccaggcacaaggtcgaatcgatgatttcacgtttgaaagccctggagcaggactcatga

SEQ ID NO: 8091 - DNA, 291 bp, Shewanella oneidensis
atgtcatttaaagagctattaatcgaagaccagcgcctagtgatcttacgctctttgcgtgagatgccagcctatgaagccaacgagtctattgtagattgttgccttgagtcctacggccataacattagccgcgaccaagtacgcacccatttggcttggcttgaagaacaagggctgatcactattcgtaaattagacgattacaaaattgcccgcttaactggccgtggtgaagatgtggccacaggccaagctaccgtgccaggtgttaaacgcccgcgggcttaa

SEQ ID NO: 8092 - DNA, 297 bp, Methylococcus capsulatus Bath
gtgaacctggagaacttcgaaactgaacagcgccgcctggtcatcctgcgccgattgatccgggcgcccgcctacaccctcgaccagaccgtgctggccaaggcgctggcgctggaaggactggccgtctcgcgcgaccgcctgaagacggacctcgcctggctggccgaacaggatctgatcgtcggccagcagcccggcggcgtctgggtggcgactttgacccaccgaggtctggacgtcgccaaggggctgacggtgatgccgggcgtggcgcggccggagccgggcgaataa

SEQ ID NO: 8093 - DNA, 309 bp, Methylobacillus flagellatus KT
gtgagtttcaagaaaatcctacaagaagacaggcgctacctgatcctgcgtgcgctcaacgaatccaagagctatcgcgcttccttgattctgctgcaggcatttctggagagctttggccaggctgtgtcaggcgatgtggtcaagggcgaagtggcctggctggaagaccagggcctggtgcgctctgaaaaaaccggccagattatcacggtgcagctgcttggccccggtgcagatattgccgcaggccgcgccacttaccctggcgtgcgtcaacctacccctgatgagctggacaatggctaa

SEQ ID NO: 8094 - DNA, 306 bp, Rhodobacter sphaeroides ATCC 17025
atgagcgactatgccgaaaccctccgccgccaccgccggctggcgatcctgcgctttctggaggaaagcccgacctacacgtcgaacgcctcggtgctgaccgacgtgctgaactcgaacgcgatcggcatcgacacctcgcgcgaccagaccgcgaccgagcttgcctggctggccgagcagggctttgtgacgctggccggctcgcgcgagttctgggtgccgaccgccacggcccgcggcgtcgacatcgcgctcggccgtgcgacgcaccccgagatccagcgccccggcccgaggcgctga

SEQ ID NO: 8095 - DNA, 291 bp, Vibrio cholerae O395
atgtcatttaaagagcttttaaccgaagaccagcgactggttattttgcgctctctgcatgagatgcatggctatgaagcaaacgagtcgatcattgattcgtgtcttgatgcttacggccacaaaatcagccgcgatgtagttcgcacccatttgttttggttgcaagagcaaggcctagtgtcactgcgtgatgtgggcgattgccaaattgcgcgcctcactggccgtggtgaagacgtggcaacgggtcaagccgttgtgccaggtgttaaacgcccacgggcatag

SEQ ID NO: 8096 - DNA, 297 bp, Shewanella baltica OS185
atggcgatgcagcaaattatcaatgagcaccaacgccttgtggtgcttcgattactgaccgaggcgggagccttcgcactcaatgagtccatcttacaagatggcttaaatgcctacggcctcgacattagccgcgatgccttgctggtgcagctcgcttggcttaacgagcaagggctgattaaaaccgaactggttggcaaagtgaccacggccacgctaacaggtcgcggccaagatgtggcgacaggccgcacggtagtgccaggggttaaacgtccacgggcgggagagtag

SEQ ID NO: 8097 - DNA, 306 bp, Xanthobacter autotrophicus Py2
gtgagcatcgccgacaccatgggcaaggatcgccgccgtctcatcctggagcatctggccgccgccgagggctacggcctcgggctcggcgtgctggtgtcgctggtcggccaggcgcgccacggggcctggcgcgacgtggtcgagggggacgtcaccatcctcgcccagcacaacctggtcgccaccgaggacctgccctcagcgctcggcccacagcgctgggtgacgctcaccggcctcggcctcgacgtggcgcgcgggcgggcgcatcccgctgtcgccgacaagctgccgagctactga

SEQ ID NO: 8098 - DNA, 297 bp, Shewanella baltica OS195
atggcgatgcagcaaattatcaatgagcaccaacgccttgtggtgcttcgattactgatcgaggcgggagccttcgcactcaatgagtccatcttacaagatggcttaaatgcctacggcctcgacattagccgcgatgccttgctggtgcagctcgcttggcttaacgagcaagggctgattaaaaccgaactggttggcaaagtgaccacggctacgctaacaggtcgtggccaagatgtggcgacaggccgcgcgattgtgccaggggttaaacgcccgcgggcgggagagtag

SEQ ID NO: 8099 - DNA, 306 bp, Leptothrix cholodnii SP 6
atgagtgcgacgcccaaattcgccgagttccagcagatggaccgccggctgtcgatcctgcaatgcctggccgctgcggcgcagtaccgggtcaacgtggggctgatccaacgctactgcgatgccgtgggccacgcggtgagccgggatcgcctctacgccgatttgacctggttgagcgagcaggccctggtcgaagtgaacgacagcggcgtgtgggtgaccacgctcaccgagcgcgggctcgacgtgtccagcgggcgcgccaagtgcccgggcgtggcgcaaccgcagccggggacctga

SEQ ID NO: 8100 - DNA, 312 bp, Rhodopseudomonas palustris TIE 1
atgagcgacacgcttgccgaagtgttcgacaaagaccgccgcctcgtgctgctgcggctcctggccgaacaggacaactacgaactgtcggcgccgctgctgaccaaggccgcccaggagctgcgccaccgcgtttatcccgacgtggtcgaggccgacatcgtgctgctcgatcagcaccgcctcgtcacccgcagcgagatcgagctgagcgggcgcaagatgacgatcgcgacgctcaccaagctcggccgcgacgtggcgcacggccggccgcatccgatggtggcgcgtcccagcccgaaggactga

SEQ ID NO: 8101 - DNA, 297 bp, Rhodopseudomonas palustris TIE 1
atgagccgagacatcattcgcgaagaagctcggctgatcatgctgcgcgagctgcacggccagaccaactatgcgctgaacgatgcgctgctgcgcgacgtgctcgaatccttcggcatcgccaagacccgcgaatgggtccgcgaggagatcggctatctcgagaacgtcggcgccgtcacccgcaccagcgccggcagcgtcgtggtcgccaagctcacgccgaagggcgtcgagcatgtcgaacggcgcctggtgatcgaaggcgtcaagcggccgtctccggcggaggcgtga

SEQ ID NO: 8102 - DNA, 318 bp, Thioalkalivibrio HL EbGR7
atgagctaccagggcaactcttatcaggactatgaaaccgagggccgccggctgggtattctgcgcatcctggcgcggcgcaatgcctacaccgccaatgagtacagcctgaacgacgagctgcgcggcgcctatgcccatcacgtgagccgcgaccgcctgcacggcgacctggcgtggctggaggagcaggggctggtgatcgtccagcagccgcgtgccggctgggtggtgacgctgaccgcccgcggcggcgacgtggccgagggccacgcccaggtgccgggggtggctcgcccgcgccccggcatcgtgtga

SEQ ID NO: 8103 - DNA, 318 bp, Agrobacterium vitis S4
atgaacagcatcgcggttgattatgaaaaactgaccagggagaaagcccgtctggtcattcttcaggagctggcaaagcagaccaacgaaagtctgtcgtccccgtttttcgacggggcgcttcgtctgagtgccatctatcaggatctgccatgggtcaatcagcagatcgaatatctgcgcaatttgagtgcggtgaaggttctcgatgttgatgaggacgtgaaaatcgccaccctgacggatcatggaaaacgtcaccttgaccgggaaatcaccattcagggtgtccagcgcccgcgccggccggggatctga

SEQ ID NO: 8104 - DNA, 303 bp, Brucella suis 1330
atgatcgtgaaagttcttactgcaaaccggctgatcgatggacaggctgtgtggcttggtgccgacggttcgtggcaggaaacgatcgacggggcgctggtcgcccgccatgccgaagccgtgaatgcgcttgaggaagcgggcaggcttgccgcccgcgccaatctggtcgtcgatgtgaatgtgatcgatgtggaggaacgtggcgcggacctttatccgatccgtctgcgcgaacgcatccgcctgtccggcccgaccatcgtgaccatgggccatgcattcccggcgcctgcctcctga

SEQ ID NO: 8105 - DNA, 315 bp, Rhodopseudomonas palustris HaA2
atgacctctccactgcaacagaagatcaagattaccggtccgtcggtggtgacggcgaaccgcacggtcgacggcgtggtgatctaccgcaccgccgatcgcggctggtcgatcgatctcgccgatgccgcgatcgtgcgcgaggcggagccggcgcgtgcgctgctcgccgaatcggtggccgacgatgtcggcgcggtcggcgcctacatcgcgccggtgaaggtcgacgacaccggcgccatccttcccggcaatctgcgcgagcagatccgcaacagcggtgtcaccatcgaactgccggctcacgcctga

SEQ ID NO: 8106 - DNA, 297 bp, Novosphingobium aromaticivorans DSM 12444
atgaagatcatcaccgggaacgacctgcgcaccggagacgtgatctggtggaccggcgaaggctggtcgcgccacgtcaacgatgcggtggaggcgggcgagcacgccgaggcgatcatcgcgcgcgagaacgccaagcagatcgtgacggacacgcacgtgatcgacgcggaacagaccgccgatggcgtccgccccgcgcacatcaaggaccgcattcgcgccctcgggcccacggtccgcctcgacctttccctcaagcctgccgaccctgccgccggcaactgggtgatctga

SEQ ID NO: 8107 - DNA, 333 bp, Rhodospirillum rubrum ATCC 11170
atgacctcctccgaccccgtcaaagccggttccgtcttttccgccgaggtgatcaccgccaatcgcctaaccgatggcaaggtggtttatcgccgtggcgatggcggttggtcggcggatttggccgaggccctgaccctgtccggcgaggcgctggccgccgagttggaccgcgcccgcgccgaacccgataccgccgtcgtcggcatctacagccacgccttggaaggtggcgaacccgcccatttgcgcgaaaggatccgcgcccagggccccaccgtccaggccggcgccggtcttcccctgtccaagatccagtccaaggcttcctga

SEQ ID NO: 8108 - DNA, 309 bp, Mesorhizobium BNC1
atgaaattgctcgcggcaaacaggttgcttgatggcaccgcagtctggctcgggcccgatgcggcttgggtcgaagatatttcggatgccgagatagcccgcgacaaggaaggcgaggcgcgcctggagcagatcggccgtcgggcgctggcagaaaatctggtgctcgatatcgagctgatcgatgtcgagatcgttgatggggccgtccgccccctgcggcttcgcgagcgcatccgcgccgcgggcccatccattcaccccgaactcggcaagcaggcgaacaagcctgcggtgtcgctggtctaa

SEQ ID NO: 8109 - DNA, 303 bp, Brucella ovis
atgatcgtgaaagttcttactgcaaaccggctgatcgatggacaggctgtgtggcttggtgccgacggttcgtggcaggaaacgatcgacggggcgctggtcgcccgccatgccgaagccgtgaatgcgcttgaggaagcgggcaggcttgccgcccgcgccaatctggtcgtcgatgtgaatgtgatcgatgtggaggaacgtggcgcggacctttatccgatccgtctgcgcgaacgcatccgtctgtccggcccgaccatcgtgaccatgggccatgcattcccggcgcctgcctcctga

SEQ ID NO: 8110 - DNA, 318 bp, Sinorhizobium medicae WSM419
atggtggaaaaggttctgacggcaaatcgtctggcggatggcatatccgtctggcttgacgcctccggcaattgggtggagtcgcttcaggatgccttcgtcgctcggcacgccgaggcggttgctgcgcttgaagcgacaggcaagcgctctttcgatgaaaacaaggtcgtggatgtcaatgtaatcgacgtcgaggaagtggacgggacgctacggccgctgcgcatgcgcgaacgcatacgcgccgagggaccatcgattccctacgctccgggatataatgggcttgcgggcccgaaaaacgttgctgcctga

SEQ ID NO: 8111 - DNA, 318 bp, Ochrobactrum anthropi ATCC 49188
atggttgtaaaagttctcactgcaaaccggctgatcgacgggcaggctgtgtggctcggtgccgacggctcctggcaggaaaccatcgacggcgcgctggtcgctcgtcacgtagaggccgttgaagcgcttgaagacgcgggcaaggttgcagcaaaagccaatctggttgtcgatgtgaacgtgatcgatgtcgaggagcgcgaggagggactttaccccatccgtctgcgcgagcgcatccgtctttccggcccgaccatcgtgacctttggcgatttgcccctcgaaaagcctgaattgaagcgcgcctcctga

SEQ ID NO: 8112 - DNA, 366 bp, Caulobacter K31
atgaaagctgtcaccgccaatcgcctgaccgacggcgaggtcgtgttctggaacgccggcgcctgggtcgagagcttcggcgacgcccagctgtttgaagacagccaggagaccgaggtcgaggccgccgtggccaagggcaagtcccaggcgacggtgatcgtcgatccctatccgatcgacctggcgcccgtcgaaggcggcctggccccggtcagctaccgcgaacgcatccgggccctaggtccgaccaacgaacccacccacggcaagcaggccgtcggcggcgagatgatcgaggcgctgcgccatgcggcgggcgcggcgcgctcgaccggccgcgtcgacctgatccgcaggaagtag

SEQ ID NO: 8113 - DNA, 315 bp, Rhodopseudomonas palustris TIE 1
atgacgtccccgctgcaacagaagatcaagatcaccggtccttcggtggtgactgcgaaccgcaccaccgacggcgtggtgatttaccgaaccgcgaagagcgcttggtcgaccgatctggcggacgccgccattgtgcgagaggctgagccggcgcgcgcgctgctcgccgcggcgactgccgacgatgtcggagcggtcggtgcctacatcgcgccggtcgagatcggcgccgacggggggatctaccccggcaatctgcgcgagaaaatccggcgtaacggcgtcaccatcgcgctgcccggccaagcttga

SEQ ID NO: 8114 - DNA, 315 bp, Rhizobium leguminosarum bv  trifolii WSM2304
atggtagacaaggttctgacggccaaccggctgacggatggcattgccgtctggctggatgcgaacgggaagtggtccacctcgctgcaggaagcgcttgtcgcccgccataacgaggccgtcgaagcgctggaggcgatcggcaagaaatcctatgccgacaacgaggtggttgacgttgccgtcgtcgaagtccaggaaaccaacggcgttctctggccgcttcgccttcgcgagcgcatccgcgcgcaagggccgaccatggaatatgcaccgggctacgctccggccgatcccgaattcattgcagtctga

SEQ ID NO: 8115 - DNA, 315 bp, Agrobacterium vitis S4
atggcagaaaaagtcttgaccgccaaccgcttgagcgatggcatcgctgtctggctcgatgcttccggcaaatgggtggaagacctgcaatcgtcgctggttgctcgtcatgccgaggctgtcgcggcgctggaagctagcggcaagcgggactttaccaataacctcgttgttgacgtcgccgtggtcgatgtggaagagcgggatggaaagctctggccgctgcgcctgcgtgagcgtattcgcgccgcaggcccgaccattccctatgcggatgggcatggtcatgctgatcctgattttgtcgccgtctaa

SEQ ID NO: 8116 - DNA, 315 bp, Rhizobium leguminosarum bv  trifolii WSM1325
atgggtgacaaggttctgaccgccaaccggctgacggacggcattgccgtctggctggatgcgaacgggaagtggtccacctcgctgcaggaggcgcttgttgcccgtcatgccgaggccgttgaggcgctggaggcgatcggcaagaaatcctatgccgacaacgaggtggttgacgtcgccgttgtcgacgttcaggaaaccaacggcattctctggcctcttcgccttcgcgagcgcatccgcgcgcagggcccgaccatggaatatgccccgggctacgctcctgccgatcccgaattcattgcagtctga

SEQ ID NO: 8117 - DNA, 201 bp, Jannaschia CCS1
atgagcgacggggacacgaacggtcctacagggccgattgaccgtcgcatgctggaggcgctcgtttgccccatgacccaggcgccgctgagctacgatgccgaaaagcaggagctgatctccaaggcggcacatctggcctacccgatccggggtgggatcccgatcatgctggaagaagaagcccgcaagctggattaa

SEQ ID NO: 8118 - DNA, 201 bp, Rhodopseudomonas palustris BisB18
atgaccacctctgcctccgaccggcccgaagccggcgtcgaccgcaaactgctggacatcctggtctgcccgatcaccaagggaccgctggaattcgacgccgcgcgccaggagctgatctcgcgcggcgccaagctcgcctatccgatccgcgacggcatcccgatcatgctgccggaagaagcccgcaagttggggtga

SEQ ID NO: 8119 - DNA, 198 bp, Rhodopseudomonas palustris BisB5
atgacgacatcctccgagcgccccgagaccagcgtcgatcgcaagctgctggaaatcctggtctgcccggtcaccaaagggccgctggaattcgacgcggcccgccaggagctgatttcgcgcggcgccaagctcgcctacccgatccgcgacggcatcccgatcatgctcccggaagaagcccgcaagctggggtga

SEQ ID NO: 8120 - DNA, 186 bp, Ruegeria sp. TM1040
atgaatgaaacgacacccgcctttgatcggcatatgctggaggcgctggtctgcccggtgacgcagaccgttctggaatatgatgccgaggcgcaggagctggtgtcgcgcgcggccaatcttgctttcccgatccgcaacggtatccccgtgatgctgacggatgaggcgcgcccgcttgaataa

SEQ ID NO: 8121 - DNA, 180 bp, Rhodobacter sphaeroides 2 4 1
atgaccgggaccactctgttcgaccgccggatgctcgaggcgcttgtctgccccgtgacgcaggcgggactggcctacgatgccgaccggcaggagctgatctcgaaacaggcgcggctcgccttcccgatccgcgacgggatcccgatcatgctggtgtcggaagcgcgcgagctctga

SEQ ID NO: 8122 - DNA, 180 bp, Rhodobacter sphaeroides ATCC 17029
atgatcgggaacactctgttcgaccgccggatgctcgaggcgcttgtctgccccgtgacgcaggcgggactggcctacgatgccgaccggcaggagctgatctcgaaacaggcgcggctcgcgtttccgatccgcgacgggatcccgatcatgctggtgtcggaagcgcgcgaactctga

SEQ ID NO: 8123 - DNA, 180 bp, Rhodobacter sphaeroides ATCC 17025
atgaccgagtccccccagttcgaccgccggatgctcgaggcgctcgtctgccccgtgtcccagtcggggctgagctatgacgccgagcggcaggagctggtgtcgcgccaggctcggctggcctttccgatccgcgacgggatcccgatcatgctggtgtcggaagcgcgcgaactctga

SEQ ID NO: 8124 - DNA, 186 bp, Sphingomonas wittichii RW1
gtgaacgaccgcacgacgagcctcgatcccgagctgctcgcgatcctggtctgcccggtgacgcggacgccgctgcgctatgacgaagctgccggggagctggtttcggacgccgccggcctcgccttcccgatccgcaacggcgttccggtcatgctgatagaggaagcgcgcgccctttcctga

SEQ ID NO: 8125 - DNA, 189 bp, Sinorhizobium medicae WSM419
atggacgtcaacgcaagcaaggtcgacccgaaactcctggaactgctcgtctgccccctgaccaagggccgcctcagctacgatccggaagccaacgaactggtctccgaaaaggcccgcctcgcctatccgatccgcgacggcgtgccgatcatgctgatctcggaggcacgcaagatcgaagaataa

SEQ ID NO: 8126 - DNA, 423 bp, Xanthobacter autotrophicus Py2
atgcctgcatcagcgggcctgatggatcgaaccagattgggggtgaaacgcccgcccgcccccgctatggtggcgccgccccgcagcggggcgatccggcgcagcctcgcgtttcttcatgacgccggcccgcgccggctggtgtccaatgcgttttctgcacgcgagccggtctgcgccgcgcctgaaaacgccctgacgagtgttgcgatgatccaagcccagcgccccggccacgacgtggaccccaagctgctcgaaatcctggtgtgccctctcaccaaggcgccgctggaatatgaccgcgagcgccaggagctggtctcccgcgccgcgcgcctcgcctatcccatccgcgacggcatcccgatcatgctggccgacgaggcccgcaagctcgacgagagcgaactctcccgctga

SEQ ID NO: 8127 - DNA, 201 bp, Caulobacter K31
atgaccaccgctccgccgcccccgcccgccgatctcgacccgcgcctgctggaggtgctggtctgtcccgtcacccgcgcgccgctgttctacgaccgcgcccggggcgagctgatcagcaacgccgccaagctggcctatccgatccgcgacggcgtgccgatcatgctgcccgaggaagctcgcaccctggaagactag

SEQ ID NO: 8128 - DNA, 198 bp, Rhodopseudomonas palustris TIE 1
atgagcctttcgccgtccgagcggcccgacactgtcgaccgcaagctgctcgacatcctggtctgcccggtcaccaagggaccgctcgaattcgaccccgcccgccaagagctgatctcccgcggtgccaagctggcctatccgatccgcgacggcatcccgatcatgctgcccgaagaggcgcggaagctcgggtga

SEQ ID NO: 8129 - DNA, 189 bp, Rhizobium leguminosarum bv  trifolii WSM2304
atggacgaaaaactcagccgcgtcgatccaaagctgctcgatctcctggtctgcccgctctccaagggccggctttcctatgatcgcgagcacaatgagcttgtctcggaaaaggcgcggcttgcctatccgatccgcgatggtattccgatcatgctggtctctgaagcccgccgcctcgacgaataa

SEQ ID NO: 8130 - DNA, 189 bp, Agrobacterium vitis S4
atggatcagcggatgaacggtgtcgatccgaaaatgctggaattgctggtctgcccgctgaccaatggccgtttgacccttaaccgggaaaacaacgagctggtttcggaaaaggcaaggctagcctatcccatccgcgatggcattccgatcatgctggtctcggaagcccgcaagattgaagactga

SEQ ID NO: 8131 - DNA, 189 bp, Rhizobium leguminosarum bv  trifolii WSM1325
atggacgaaaaactcagccgcgtcgatccaaagctgctcgatctcctggtctgcccgctctccaagggccggctttcctatgatcgcgagcagaatgaacttgtctcggaaaaggcgcggcttgcctatccgatccgcgacggcattccgatcatgctggtgtcagaggctcgccgtcttgatgaatag

SEQ ID NO: 8132 - DNA, 441 bp, Pelobacter carbinolicus
atgtttgaagaaaaaaaattacaggaactgaaggatatgtgcaggtctcgaggcgtcagcctgacgccgcaacgtctggcggtcatgcgtgtgctgacggcgcgccgcgaccatccgaccgtcgaccagttgtatgacgatctgacggagcaaatgccgggcatgtcccgcacgacggtttaccgggtgctggaaactttcgagagacttggcctggtgcgcaaaatcgacagccgtgcctccaaggcgcattttgacgccgacaccagtctgcatccgcatatggtatgtctcggttgcggcaaggtggtcgattatcaggatcggggattcgggattctggagccccccggcatcaccgatgacgggtttgaaattatcgattatgcggtgaccctggtaggttattgtcggcaatgccgaagaaacgttgataattga

SEQ ID NO: 8133 - DNA, 450 bp, Chlorobium luteolum DSM 273
atgatgaacgcaaccacagagggctcgatgacagaggagttcatgctgcgatgcagggcacacgggctgaaaatcacccctcagcggcttgcaatcttcaaggcgctggcaggctcgaaagaacacccttcagcagacggcgtatacaggaaactcgtagcactgcaccctacgatctctttcgataccgtgaacaggacgctgctcacctttgccgaaatcggcatcatcgaaaccgttgaatcccactccggcgtccggcgcttcgacacagacctcatgagccaccaccacctgcactgcgtgcagtgcggcagaatcatcgacttcaccgatgaaacgctcgacaaggtgcccgtaccggagaaagccatcggcaacttcaccgtactcggcaagcgcatggtggtcagcggaatctgcgagagctgcaggaaaaaacatgcatga

SEQ ID NO: 8134 - DNA, 441 bp, Frankia CcI3
atgaacgaccagaccgatcttcgtctcactccgcagcggatggccgtgctggcggtgctggctgccgcccgcgaccatccgaccgcggccgaggtccacgagcgggtgcggaccgtatccccggggatcggcagtgcgaccgtgtaccgcacactggcgttgctggtatccgccggccgagcgctcgagctgaacctgggcgacggcacggcggcccggtacgacgccaacacgagtcgtcacgaccacgtggtctgcgacggatgccgtcgggcggtcgatattgatcatcccgtcctcgacgggatgatggcccagatcgcgtgtcgctcgggattcgccatcaccgggtacgacctgcggttccgggggctgtgcccggactgtcaggcgaacggctccggcccggcccgcggcgcggccgggaccggccaacagtga

SEQ ID NO: 8135 - DNA, 450 bp, Pelobacter propionicus DSM 2379
atgacaccactctccaacagcatagatcacctgacccagactttccgcgagtcaggtttgcgtgttacccatcagcggcttgagatttaccgggagctgatggaggccagggatcatcctacagctgaacaactgtatcgcaggctgcgcgggcgaatcccgaccctctcgctggatacggtctaccggaccctgacgactctggtcacccatggcatggtcaagcgcctggagacggtggagagtcaggcgcgtttcgacacgacccggcagcgccaccatcatatcatctgcaagcgctgcaacgaaatcatggacttccactggccgctgctggatgagacgccgctgccgggagaggtggattcgtggggcaggctcgacggagtcaacgtggtcgtgtacggcgtctgcgcccgctgtcttgcaggagacgcccaaccgacctga

SEQ ID NO: 8136 - DNA, 387 bp, Desulfovibrio vulgaris DP4
atgtctcaaacccgtatgaccaagcaacgcatggtcattcttgaagaactgcgcaaggtcgatacgcatcccactgcggacgagatctatgccatggtgaggtcgcgcatcccgcgcatcagccttggtacggtctacaggaatctcgacctgctcgcggagtcgggagagatactgcgactggaagctgccgggacgcaaaagcgtttcgacggtaataccatgcatcatcagcatgtccgctgcatacgttgcggccgcgtgggtgacgtgatgcaccctcttgatgtgccacaacctgaacgggcagctgcaaaaggctttaccattctgacggctcgtgtagaattcgaaggcatttgcgaccattgcacagcacatagctga

SEQ ID NO: 8137 - DNA, 414 bp, Fervidobacterium nodosum Rt17-B1
gtgaacgttaccgaactgttaaaggaaaagggagttaagccaactgtacacagagttgagattcttgattatcttatgagcacttattcacatccaacagctgatgaaatatactatcatttcaagaaaggacaaaaacttgctgttatatctagggcaactgtatataacactttaaaagcacttgcagatgccggtttgatttctattataatcacaccagatgcaataagatacgactttgtaagaaaaaaacatcatcacttttactgcaccaactgtaaaacaatttacgacgttgagttagaagtcgaattgccagaaattaaatcaatagacaatcatgaagttcatcatgtccaattaacgttagttggaatatgtgaaaaatgtaaaacaaatcaagaaatttaa

SEQ ID NO: 8138 - DNA, 426 bp, Frankia EAN1pec
atgccggagcggaccgaactacgtctcaccccccagcgcacccgtgtgctggaggtgctgaaggccgccgaggaccatccgacggcggccgaggtctacgagcgtgtgcggctcgcggcccccgggatcggcagcgcgaccgtctaccgcgccctcgcgttgctcgtcgagaccgggcacgccctcgagctcaatctcggggacggcgcggccgccaggtacgacgccaacaccagccggcacgaccacgccgtgtgcgagcggtgcggccgggccgcggacatcgaccaccccgtcccggacggcatggtggccgagatcgcgcgccggtccggtttcacgatcaccgggtacgacctgcagttcaggggcctgtgcccggagtgtcagaccgccggcgagggccatcgcccgggccgacggtag

SEQ ID NO: 8139 - DNA, 405 bp, Caldivirga maquilingensis IC-167
atgagtgaagacttggcaaatctcctacggagtagaggattgaaggtgacgccgcagaggattgccatacttaagttactgagcagtggtgggcactacactattgagcatgttcatgataaattaagggatattgaacctggtataagtatctctactgtctataatactttaagcacattaaccaggcttggtgttctaaggtcctttgaagctaatggtaagacctggtacgaaatagctaagcacccgcatttaaacgtcatatgtgagaacactgggcaaataattgatattgatgttgacttaacttggattatggatgaattaatgcgtagggggattaaggttaaggacctaaacattattgttaatggggactgctctaagatggaggggaagtag

SEQ ID NO: 8140 - DNA, 402 bp, Elusimicrobium minutum Pei191
atgagatattcaaaacaaagagaaattattttaaacgctttaaaaagtaatcctattcatccgactgctgattatgtttataacagtttaaaaaaggataatccgtctttaagcctgggtactgtttatagaaatttaaatttactttcagatataggggtaatacgtaaaataaggggcatgggtaacagtgaacactttgactataatacgcataaccatgcgcattttatatgcgcaaagtgttcgcgaatatttgatattgacatagacggtaatttttatgagattttaaaccttatagctaaaaagaacgggcttgatattgaacccggcggattagttttaaagggcatgtgtaaaaattgtaaaaaggataaaaataaggagagaaaacaatga

SEQ ID NO: 8141 - DNA, 396 bp, Desulfovibrio vulgaris  Miyazaki F
atgacccagccgcaacagactcgcatgaccaagcaacgcatggtcatccttgaagaactgcgcaacgtgcacagtcaccccacggcggacgaggtgtacggcatggtccggcagcgtctgccgcgcatcagcctgggaaccgtgtatcggaacctcgacctgctggcagaatcgggtgacatcctgaagctggagtcggccgggtcgcagaagcgcttcgacggcaacgtcaccccccaccaacacgtgcgttgcacccagtgcgggcgggtgggcgacgtgatggaacccgtgcgcctgcccgacatctcgggcgcgggggcccccggcttcatcatcctttccggacgcatcgagttcgaaggggtgtgcgaggcctgcgcgtcgaagaactga

SEQ ID NO: 8142 - DNA, 432 bp, Thiobacillus denitrificans ATCC 25259
gtgaccgagatcatcttctatacctttgccgaagaccgcctcgacgtcgcgcgccgcgtggcggccaaggcctacggtcaaggcaagcaggtgatgatctatgcgcccgatgcggccgtcgcaggcgcggtggatcgcatgctgtggacgacaccggcgctcggtttcgtgccgcatgcccgcgacagcgacgcactcgcggcggaaacgccggtgctgatcggcgccgacgccggcgcactccgccacgccgacgtgatgatcaatctcgattccgcgcaaccgccggccttcggccgcttcgagcggctcgtcgaaatcgtcggcacggacgacgcggagcgcgaacagggccgcgcgcgctatcgcttctatcagtcgcgcggctacgcgctgaagacgcacgatctgcgccagcagagcgagggatga

SEQ ID NO: 8143 - DNA, 435 bp, Rhodoferax ferrireducens T118
atgactgaggtggcctttcacttcaatgcacccgaccgggtcgcctatgcctgccgtctgctgcgcaaggccgcggcaagtggtgccaagcttgtggtgataggttcgccggacgtgctgcagcaactggaccgcgccctttggacgttttcagccgttgattttgtgccacattgttttctggagagtgagtcacacgtcgttgccgcttcgcccgtgattttgtcgacatccacccatgcggtgccccaccagcaggtgcttctcaaccttggccaacttgtgcccgaggggtttgagcgctttgagcgtgtcatcgaggtggtcggccaggaggacgaagatcgtcagtcggcgcgaagccgctggaaaagttatgccgatcgtggctacgtcatcacacgtcatgatctggctttgaaaacgtcgtactga

SEQ ID NO: 8144 - DNA, 438 bp, Polaromonas JS666
atgaccgagatcgcctttcatttcaacgtacccgacaagctggcctacggttgccgtttgctgcgcaaggcgtatctcagcggcgccagcgtggtggtgacggccgaggccgatgtgctggcgcagcttgatcaatcgctgtggagcttttcccctacggaattcgtaccgcattgccgcagcgatgccggggaggacaacctcgccgtgacaccggtattgcttgccgagtcgctgcaggactgcgcccgtcatgaggtgctggtcaatctggggcagggcattcctgcgggatttgagcgctttgagcgcttcatcgaggtggttgcgcagggtgacgatgagcgtctggccgcgcgcagccgatggaagcattacaccgacaggggttacaccatgaagcgacacgaccttgcaacggccaagggaggcgcatga

SEQ ID NO: 8145 - DNA, 435 bp, Acidovorax avenae citrulli AAC00-1
atgaccgagatcgccttccatttcaatgcgccggacaagctcgcctatgcgtgccgcttcgcgcgcaaggcggtgcgcagcgatgcgctgctggtcatcacgggaccttccgccgtgctcgatgcggtggaccgcgccctctgggcgctgggcccgcaggatttcgtcgcccactgccgccaggaggacgaggccgatctgcgcgaggcctcgcccgtgctgctggcgaccgatccccgcgccgccacccatgcgcaggtgctgctgaacctcggccccacggtgcccgcgggtttcgagcgcttcggccggctggtggaagtggtgagttccaccgacgaatccgaccgcgccggagcgcgcgagcgctggcggcactacgcccagcgcggctacgccatcgtgcgccacgacctggtgctgaaggggggctga

SEQ ID NO: 8146 - DNA, 441 bp, Acidovorax sp. JS42
atgacacaggtggcattccacttcaatgcacccgacaaactggcgtatgtctgtcgcctggtgcgaaaagccacccggcaggatgcgcgggtgacggtcacgggtgatgcagacaccttgctgcggctggatcgccagctctgggcgttggcgccttcggatttcgtcggccattgcctgggagacgccgacgaggaaattctgcgtgcctctcccaccgtgttggtgcaagaccctcgtaccagtccgaatcgggacgtgttggtcaacctgggaaatgtcttgcccgagggatttgcgcagtacgctcgggtcgtggaggtggtcagccaggtggatgaggatgatcggaagcgcgcgcgggagcgctggcgcggctatgccgcgctggggtatgacatcgttcgccacgatctggtactcaaggaaagcgcgggatga

SEQ ID NO: 8147 - DNA, 441 bp, Polaromonas naphthalenivorans CJ2
atgaccgagatcgcctttcatttcaatgtgcccgacaaactggcttatggctgccgtttgctgcgcaaggcctatctcagcggcgccacggtagcggtcatcgccgagcctgaagtgctggcggaactcgatgcgctgctgtggagtttttccgcgacggaatttgttccgcattgcacgggcgcggcatcgcccggcacactggcggccacgcccgtcgtgctggcggcatcgccggcggattgtccgggccgtgacatcctggtgaacctgggccagggcgtgcctggcgggtttgaaggattcgagcgcttgatcgaggtggtttcaatacaccccgaggatgtaccggccggacgagaccgctggaaacattacgcggcgcgcggctacaccctgaaaaggcatgacctggccagccgggccagaggcgcggcatga

SEQ ID NO: 8148 - DNA, 435 bp, Verminephrobacter eiseniae EF01-2
atgaccgaggtcgctttccacttcaacgcaccggacaaactggcctacgcctgccgctttgcgcgcaaggtgcagcgcagcgacgcccgcctggtcatcgctgcgcccgcgcagatgctggcggccctggaccgcatgctgtgggcgctggagccccaggacttcgtggcccattgccgcgacgacgcagaccaggaactgctggcggcctcagcggtgctgctggcgcaggatgcgcgcagcacggcgcaccacgaggtgctgctgaacctgcaaccccaagtcccgcaaggctttgaacggtttgaccggctggtcgaagtggtcagtgcccaagacccggccgaccgcaccgaggcgcgcgcccgttggcgccactatgcatcattggggctggccatcacgcgccatgacctggtgccgaaagctctttga

SEQ ID NO: 8149 - DNA, 438 bp, Leptothrix cholodnii SP 6
atggcgatgggggcggtggcctttcacttcaacgtgccgcaacggcaggactacacctgccgcttgctgcgcaaggcctgccgggccggcgcacgggtcgccgtgacaggcgattccgcggcgctgggtgaactcgatcgccagttgtggatcttcgatccgatcgatttcgtgccgcactggcgcggggtttcggccgatcgcctgcccgcacgattgaaggcgacaccgatcgtcctgctcgatcaggccggcacacaggccggacatgacgtgctcctgaacctggccgaacaggtgcccgactgtgcatcgcagttcgcgcgcgtcatcgaggtggtcgggcgctccgaggccgatcgttcgcaggcccgcctgcgttggcgtcactacgccagcctgggcgccgccatcgaacgccacgaggtgcgaccttga

SEQ ID NO: 8150 - DNA, 441 bp, Diaphorobacter TPSY uid29975
atgacacaggtggcattccacttcaatgcacccgacaaactggcgtatgtctgtcgcctggtgcgaaaagccacccggcaggaggcgcgggtgacggtcacgggtgatgcagacaccttgctgcggctcgatcgccagctctgggcgttggcgccttcggatttcgtcggccattgcctgggagacgccgacgaggaaattctgcgtgcctctcccaccgtgttggtgcaagaccctcgtaccagtccgaatcgggacgtgttggtcaacctgggaaatgtcttgcccgagggatttgcgcagtacgctcgggtcgtggaggtggtcagccaggcggatgaggatgatcggaagcgcgcgcgggagcgctggcgcggctatgccgcgctggggtatgacatcgttcgccacgatctggtactcaaggaaagcgcgggatga

SEQ ID NO: 8151 - DNA, 444 bp, Variovorax paradoxus S110
gtgacggaaatcggctttcatttcaatctgccggacaaggcgaactacgcctgccggctggtgcgcaaggccgtgagcgtgcgcggcttgcgggtggtcgtggtgggcgagccgcagatgctggaggcggtcgatgcggcgctctggcagctctcgccctgcgacttcatcgcgcattgccgcggcgatgcgcagccccacctggtggcgcgctcgccggtcattctttgcgccgagggcgcggacgccgcggggctcgcgcaccgcgagatgctggtcaatctcgggcccacggtgcccgtcggcttcgagcgcttcgagcgcctggtcgacatcgtgagcaacgagaccgacgatcggcagatcggccgctcgcgctggcgccactatgccgaccggggctattcgatccagccgcacgactttgcaaggagcgcctcctga

SEQ ID NO: 8152 - DNA, 447 bp, Frankia CcI3
gtgagctacacggccctggcggtcgtcggggtcgcgttggcgatcgcgatggacctgtgggtcctgcggacccggctgctgacccggcgggttttctggacttcctatgcgatcatcgcgttgttccagttgatctccaatgggatcctcaccgggttcggcatcgtcgtctacgacccccgccggatcctcggcccgcggatcgcgcacgctccggtcgaggatctgctgttcggcttcgcgctggtgacccagacgttggcatggtgggtctggtgggggcgccggctgcggggcgggccgcccggcaggcctcgcagccggcggaccggggagagccgggaggccagcgacaacggcgacaacggcgacaacggggtcaatggggagaatcggggcatcccgtctcgacccgagggccgagagagatctcggcgtacttcgtga

SEQ ID NO: 8153 - DNA, 342 bp, Mycobacterium MCS
atgatcggtctcggctacaccctgcccgcgatcgtcgcggtggtcgtggtggtggcctgggaggttctgtggttgcgcaccggcctgttccggcggccggcgtactggatctcgatggtcatcgtggtgggcttccagatcccggtcgacggatggctgacgaagctcagcgaccccatcgtcatctacaacgaggagcacaccagtggcatccggttcccctgggacatcccggtcgaggacttcctgttcggtttcgcgttggtgaccggggtgctgctgctctgggagcgtcagcggaccagaggcgtcaaggtcggcgagcgggtgcacgatgagtga

SEQ ID NO: 8154 - DNA, 342 bp, Mycobacterium KMS; identical to SEQ ID NO: 8153

SEQ ID NO: 8155 - DNA, 342 bp, Mycobacterium JLS
atgatcggtctcggctacaccctgcccgcgatcgtggcggtggtcgtggtggtggcctgggaggttctgtggttgcgcaccggcctgttccggcggcccgcgtactggatctcgatggtcatcgtggtgggcttccagatcccggtcgacggatggctgacgaagctcagcgaccccatcgtcatctacaacgaggagcacaccagtggcatccggttcccctgggacatcccggtcgaggacttcctgttcggtttcgcgttggtgaccggggtgctgctgctctgggagcgtcagcggaccaggggcgtcaaggtcggcgagcgggtgcacgatgagtga

SEQ ID NO: 8156 - DNA, 303 bp, Frankia EAN1pec
atgagctacaccgcgctggccgtcgtgggcgtcgccgtgagcgtgctgctggacctgcggatcctgcgtacccggctgctcacccgccggctgttctggacggcttacgcgatcatcgtcttcttccagctcgtcacgaacggcattctgaccggcttcgacatcgtcgtgtacgacccggacgcgatcgccgggccccgcctcgtgttcgcgccggtcgaggacctgctgttcgggttcgcgttggtaacccagacgctggtgtggtgggtttggtggggacttcgtcacggaaacgagtga

SEQ ID NO: 8157 - DNA, 309 bp, Acidimicrobium ferrooxidans DSM 10331
gtgagctacacgctcgaggcggtggcgctcgcgatcgtggccgtcgccatcgactggtgggtcacgcgctcgcgtgtggtgcgaaccgcgtcgttctggatcacctgggtcgtggtcgctgcgttccagatccctgtcgacggagccctcacccgactccgcgcgccggtggtggagtaccgatccgggacctacctcgggatacggctcggccacgccatcccgatcgaggacttcgtctacggctttgccctcgtgctcgtgacgatctccctctgggtccggtttggtcgtcgcgcgagtcgctag

SEQ ID NO: 8158 - DNA, 327 bp, Actinosynnema mirum DSM 43827
gtgagggagtacctgatcgcctcggcggcctcggtgccgctgaccgtgctgctggagctgctggtgctgcgcaccggcctgttccgcaagcgcgcctactggatcaccatggcggtcgtcctcgggttccaggtcccggtggacggctggctcaccaagctcgacgcgccgatcgtggtctacgccgactgggcggccagcggtctgcgcttcccctgggacatcccggtcgaggacttcctgttcggcttctcgatggtcacggtcacgctcctgctgtgggagcgggcccgcgcgaggaaaacggagcacgcggatgcgcgttga

SEQ ID NO: 8159 - DNA, 393 bp, Saccharomonospora viridis DSM 43017
atgaccggcctcggctacaccctgcccgccgtgctgtcggtgctcgcggtgtgcgcgtgggagctgctcgtcctgcgcaccggtttgttccgcaaacccgcctactggatctcgatggcgatcatgctgggtttccagatccccgtcgacggctggctgaccaagctctccgcgccgatcgtgcgttacgtcgacgagcacacgctcggcgtgcggtttccctgggacatccccgtggaggatttcctgttcggcttcagcctcatcacggcggtgctgctgttgtgggaacaccaacaacgccacggcacacgaaagcgccgcgaacgggcatgggcaccgggtgctcacgagactcgaccgggtgtcccgcaggaaacggaggcgccgtga

SEQ ID NO: 8160 - DNA, 327 bp, Nakamurella multipartita DSM 44233
gtgatcggcgcctacaccgctggcgcgatcggggcgatcgtggccgccgtcctgatggacctggtgatcgtccggacccggctgctgcgcacccggctgttctgggccagctacgcgatcgtggtgttcttccagctgatcgtgaacggaatcctgaccggtctgggcatcgtgcagtacgacccggaggtgatcctgggcgtgcggctggcctacgcgccgatcgaggatctcgggttcgggttcggcctggtcacgctgaccctggtgatgtggacccggtcgggccgcaccgcggcccagcgggcgacggaggagacgagatga

SEQ ID NO: 8161 - DNA, 657 bp, Anaeromyxobacter dehalogenans 2CP-C
atgaagcgactgctggagcggagccacgcgctgctcaccgcgccggtcggggcgacgccgcgggtgctcgcgctcgtcgccgcgctgctcgtcgtcccgacgtacgtcgcgccgctctggaacctcaccatgttcgcgccgcagtacggggacgggctccggctggacatctacagctacaagctcgagggcgggaaccacgggcaggacctgaaggagatcaacctcctcaaccactacatcggcatgcacgacctcgcggaggaggacttccgcgagttcaagtggatgccgttcgtgatgggcgggctcgcgctggtcttcctgcgggccgcggtgatgggccgggtgctcgacctgctggactcgctggtggtcttcacctggttcggcctcttctcgctctggtcgttcggctacaagctgtacagctacggccacgacctcgcgcccggcgcgccggtgaaggtgccgcccttcatgccgccgatgatcgggagcgcgcagctcgcgaacttcgaggtgtactcgtacccgggcctcggctcctacgcgctgttcgcggtgggcctcgcgctcgccgtggccctcgccctcggggtgcgcgccacgctccggcgttcggcggccgcgccgctcccgcgcggcgggccctga

SEQ ID NO: 8162 - DNA, 687 bp, Anaeromyxobacter sp. Fw109-5
atgacgcgcctgctcgagagcagccaccgcgcgctctcgtcgccggtcggaggcacgccgcgggcgctcgtcctcgcggcggcgctcctgctcctgcccacctacttcctgccgctctggaacctgacgatgttcgcgccgcagtaccagggcgggctgcggctcgacatctacagctacaagctcgagggcgggaacgagggccaggatctgaaggagatcaacctcctcaaccactacatcgggatgcgagatctcagggaggacgacttccgcgagttccagtggatgccgttcgtgatcggcgtcctggcgctgctcttcctgcgcgcgatcgtgatgggccggctgctcgacctcgtggactcgacggtcctgttcgcctggttcgcggggttctccgggtggtcgttcgcgtacaagctgtacagatacgggcacgacctcgccccgacggcgccggtgaaggtggacccgttcatgccgccgctcttcggcgggacgcagctcgccaacttcgaggtctactcgtaccccgccgctggatcgtacgcgctcctcgcggcggggctggcgctcgtcgccgccctgctcctcgcggcgcgcgcggcgctccgggaggcgcgggctgcacgcggcgggacgtccccggccggcgcctcctcggcccggaccgccgcacgatga

SEQ ID NO: 8163 - DNA, 756 bp, Campylobacter concisus 13826
atgagtaaatataaaatttataccattgttgcacttatcattatgagcgtttgttttactctgccagttcttggctggcacggagcaaaagagcgtatagctaatggcgatgagctaccatcttatgcttacactatctacgatctttatagctcatttcagtataaaaaccaccttttaccaaaagaggtggcaagtgatcttcacaagatgatcgagcaaaaagcagagatcggcactccatctcttcctatctggtacgtatctcttgaagcgccaaactatccaaaggcagcctttccagatggcataccagtatattttcacgtagatggatatagtggcgacgtgcacgagatgaacacgataaaccactacatcggcatgtatcctatggagcatggcggcaatatcgagcgagcgatcgcgccttattatctacttatcgccacactttgcatgcttgcgtttttatactatgacggtaaatttaactcacttttaatggtgccaaccatcatcgcgccggtgctatttatgagtgcatttgtgggctggctatactggtatggacacaatatgcaagagtggggcgcctttaagatcaaaccatttatgccaaccgttttaggcgatggtagcgtggcgcactttacaacgcactcatatccaactatcggcttttgggtgatgatggtgatgagcgtgctttgcatacttgcggtcttttcaaagaaaaaagagctaaatgcgtaa

SEQ ID NO: 8164 - DNA, 621 bp, Opitutus terrae PB90 1
atgcgtagtcttctccgtcgcgaatacgtcttcctgcgccggcccttgtcgttcggtgcgcgcattgtgttgttgcttgccgtggtgagcctggtgctggcgctcgtgctgccgctctggcggattggcctcgtcgcgccgcaatatcaggaaggcctgtcgctgcggatctacagttaccagctcgtggcgggaaacaacgggcaggatctgaacgagatcaacaatctcaatcattacatcggcatgaagccgctggccgaggccgacttcatcgagatgcgctgggtgccgtttgcgctcgggtttttcgtgctgcttggtttgcgcgcgacggcgctgggcacgatgcgcagcttgatcgacctgctcgcgctatatctttatttcacggcgttctcgttcggcagtttctactaccggctctacacctacggccaccagctcgatcccaaggcgccgatgacgattcaaccgttcacgcccgtgctgatcggccggcaacagatcgcgaacttcctccagagcagctggccggaaatcggcgcgctgttcctcggcctgttcccggtgctgatcgtgctcgcgatgtggatgtcgcgccaggaggacccggtgtga

SEQ ID NO: 8165 - DNA, 567 bp, Sulfurihydrogenibium YO3AOP1
atgataaaaagagtacttttaattttagcgggtattttactaatcggggtttatttttttcctatatgggagatacttttttatgctccacaatatcccgaaggtttagggatgttaattcatgtaaataaaattactggattgggtgagcacgatattgaaattataaatgatttaaaccattatatcgggatgaaaacaatagaagaaaactcgatccctgaacttaagataatgccatttattttggcttttttaataatttatgcttttattgcagcaataataaataaaaaattagtaaccttaacattctcggcaataataactcttttaggcatagctggtttggttgatttctatttgtgggaatacgattatggccataatctcgctccaaatgctccaataaaagttgatccattccaacctgcatttattgggcataaaccatttttaaattttgatatttattcatttcctcatataggaggtgcgttattaggtttggcaattgtacttgcttggctatcaacatatctttattttaaagagggtaaaaaatga

SEQ ID NO: 8166 - DNA, 657 bp, Anaeromyxobacter sp. K
atgaagagactgctcgagcggagccacgcgctcctcaccgcgccggtgggcgcgacgccgcgggtgctcgcgctcgtggcggcgctgctcgtcgtcccgacctacgtcgcgccgctgtggaacctcaccatgttcgcgccgcagtacggggacgggctccggctggacatctacagctacaagctggagggcgggaaccacgggcaggacctgaaggagatcaacctcctcaaccactacatcggcatgcacgacctggcggaggaggacttccgcgagttcaagtggatgccgttcgtgctgggcggcctcgcgctcgtcttcctccgggcggcggtgatggggcggctgctcgacctgctcgactcgctggtcgtgttcacctacgtcgggctcttctcgctctggtcgttcggctacaagctgtacagctacggccacgacctcgcccccggcgcgccggtgaaggtcccgcccttcatgccgccgatgatgggcagcgcccagctcgcgaacttcgaggtgtactcgtacccgggcctcggctcgtacgcgctgttcgcggtggggttcgcgctggcggcggcgctcgtgctgggcgtgcgcggcacgcggcggcgcgtcgtggccctgccggtcccggccggcgggccctga

SEQ ID NO: 8167 - DNA, 600 bp, Desulfitobacterium hafniense DCB 2
atggattttgtaagaaagcttttcaagggaaaccttaatctcatcgggagaatcatgtttggtgctgccggcttaattctcttagcctctctctttttgccttggtggcatttagacttggtggcaccccaatatccggagggtttgtccgtgattgtctatccggacaaactggatggccgcatcgatattatcaataatattaatcactatatcggcatgaagtggatcagcgaagaagatttcccggaatttcaggttattactaaagttgcctatgtgatcattggcctggctcttattaccgccctggtgaaaaaaaggtggcttgcctggctgaccgccggtctgggtgctgtgggaggcatgatcggggtgtatgacctatggcgctggctgcgggattatggaacccagctggatcccatggcggcaattaagatcgatcccttcaccccgccgattatcggcaccaataagcttgccaattttattacctacacaggatttaattcaggcggatatttgctgggactgagcattatcctgatgctgctggctgcttggaggtttaaggaacatgaaaagcaaaaagaatag

SEQ ID NO: 8168 - DNA, 657 bp, Anaeromyxobacter dehalogenans 2CP 1
atgaagagactgctcgagcggagccacgcgctcctcaccgcgccggtgggcgcgacgccgcgggtgctcgcgctcgtggcggcgctgctcgtcgtcccgacctacgtcgcgccgctgtggaacctcaccatgttcgcgccgcagtacggggacgggctccggctggacatctacagctacaagctggagggcgggaaccacgggcaggacctgaaggagatcaacctcctcaaccactacatcggcatgcacgacctggcggaggaggacttccgcgagttcaagtggatgccgttcgtgctgggcggcctcgcgctcgtcttcctccgggcggcggtcatggggcggctgctcgacctgctcgactcgctggtggtgttcacctacgtcgggctcttctcgctctggtcgttcggctacaagctgtacagctacggccacgacctcgcccccggcgcgccggtgaaggtcccgccgttcatgccgccgatgatgggcggcgcccagctcgcgaacttcgaggtgtactcgtacccgggcctcggctcgtacgcgctgttcgcggtggggttcgcgctggcggcggcgctcgtgctgggcgtgcgtggcacgcgccggcgcgtcgtggccctgccggtcccggccggtgggccctga

SEQ ID NO: 8169 - DNA, 855 bp, Halorubrum lacusprofundi ATCC 49239
atgacagcctcactcgaccgactgacggagcttaggcgggcgctcccggtgacggcggcggcgatgttcgtcgtcgccctgctggtgcccgtctggcggatcgccttcgaagcgcctcagtaccctgagggcctgctcgtcgagctgtacgcgtacccccgcctcggcggcgactacgccgaggtgcaggcgctgaaccactacgtcgggttctactacccggacccggtgttcgtcgatccgaactacgcggtccatccggacgcgatcgccgcgccggagtggatcctcggacccgtcgtgttcctcgcggtggccgccgcgggcgtgttcgtcgcgctcgcgcccaccgaccgaaagctccgtctggggctgctcggccagttggccggggcgacggtggcgttcgtggggacgttcgcgatcgtgcagtaccggctgttccaggcgggtcacgcgctcggcgagagcgcgccggtcgtcggagtgcgggagttcaccccgccgcttctgggcggctacgagatcgccaacatcagcggggtggcgtggttcggtcccggcggctacctcgcggggatcgggtttctcctcctcgtcgtcgcctacctgctccgcgactcgcaggtcacggtcggcgaggcgcccgggagggtccgagatcgcctctcgggaggtaacgaagacggcgacggcgacggagagcccgaacagatcggtccggccgccgaggaaattgccgaggcacagaccgccgcgaaccccgaatccgtctcgaccccggacgggccgacatcggacgactcgggaacggacggatcgacccaaaacggacccaaaacgggggtaaactga

SEQ ID NO: 8170 - DNA, 303 bp, Dechloromonas aromatica RCB
atgtgcctgggtatccccgttcaggtgatcgagtgcggcgagcactttgcccgctgtgccggtcgtaacggcgaagtgcgggtcgacctcagtctggtcggccagcagttgccgggtacctggctgctgacttttctggaagcggcgcgcgaggtcatcgatgccgagcgggccgctgccatcaatgccgccctgaatgcgctcgctgccgcccatgccggtgaaaccgatttctccgactttttcgccgatcttgatcgcgaaccccaactccccgactttctgaggacacaactatcatga

SEQ ID NO: 8171 - DNA, 303 bp, Cupriavidus metallidurans CH34 uid250
atgtgcatcggcatccccatgcaggtggtcgaggccgatggccgcttcgccttgtgcgaaggccgcggcgagcgccgccgcatcaacaccgccctggtcggcgaggtctccagcggcgattggctgctggtcttcctcgacgacgcgcgcgagcgcatcgataccgaccgcgcgaccgaggtgaacgcggcgctggacctggtgctcggtgccatgcagggtctggaggcgcaggatgacgcgggctttgccctgccgtcgcagatgagcccggaacaaatgcgcgccctgaccggcgcctga

SEQ ID NO: 8172 - DNA, 318 bp, Rhodobacter sphaeroides 2 4 1
atgtgcgtcggggatccgctgcgcctgatcgcggtcgagggcattgccggcaccgccgaagacggggcgggcacctgcctcgtcgatctcagcctcgtgcccgaggcacggccgggcgactgggtgctctccttcctcggcaccgcccgtgcggtcatcgccgcggacgaggccgcgcggatttcggccgcactggcggcgctgcgctcggtgatgaccggagggccggtcggagacgccttcgccgatctcgaccgcccgccgtcgcttcccccccacctgcaggccgcgctcgacgcgggccgcaaccacggatga

SEQ ID NO: 8173 - DNA, 387 bp, Alkalilimnicola ehrlichei MLHE-1
atgtgcattggcataccgatgcgggtattggagtgtcacggtacctgggcgctcgcagaaggttgccagggtgtggctcgggtggacctgatgctggtcggcccgcagcctgtgggtagctggctgctggtgcatatcgacacggcacgggaggtcatcgacgggcagcgcgccgcagagatcgccacggcactggaggcgcttgaggcagcgcgtgccggtgtaacagttgcgggcctgtttcaggatctcgaaggacgtgagccgcaactgccggcacacctcaggccgcaggatgacggcgacggaagtcaacctgaaagcgctcaacgacatagtgttggaggcaagatttatgagccaaatcctgctggatcaactgactga

SEQ ID NO: 8174 - DNA, 312 bp, Paracoccus denitrificans PD1222
atgtgcatgggcatcccgatgcggctggcgcaggtcgacggcatcgcggggcaaagcgagggcggcgatctgatcgacctcagcctgaccgccgatgcgcaagccggcgactgggtgctgaccttcctcggcacggcgcatgaggtgatcgacgctgaccgcgccgcacggatcgcggcggcattgcaggggttgcgggcggtcatggcggggggcgacgcttcgggcgcctttgccgatctcgagggtcgcaccccggcgcttccgtcccatcttcaggcggcgttggccgcaggccgcaaaacgggttga

SEQ ID NO: 8175 - DNA, 327 bp, Polaromonas naphthalenivorans CJ2
atgtgtatcggaattcccatgcaggtgctgtcgctcgaaccggggcatgccaattgccagggccggggccaggcgcgccgtgttcgcaccgccctggtcggcagcgtggcggctggcgactggctgctggttttcctggacagcgcgcaggaatgcatcgacgcgcagcgggcgcaggaaatcaacgcaaccctggacctgctggaggcggtattgcagggccatgaaacgaagaacacgccggaccggctcgaccacgttgcctttgaactgccttcgcgcatgagccgcgagcagctgctggcactgtccaccggcatttattaa

SEQ ID NO: 8176 - DNA, 333 bp, Methylibium petroleiphilum PM1
atgtgcatcggacttcccatgcaggtgttgagcgtcgagcccggtcacgcgcagtgccgcggccgaggtgagtctcgccgtgtccggacggcgctggtgggcgacgtcgcacccggtgattggctgctcgtgttcatcgacagcgctcaggagcgtctgacgaccgagcgcgcgcgcgagatcgacgccacgctcgatctgctcgaagcggtgatgcacggcgatgccgccgacggcgtcgcctccttcgccctgccgtcgcgcatgaaccaggacgaagtccttgctttggcgggggcggcatccagccccactttggagaaatcaccatga

SEQ ID NO: 8177 - DNA, 318 bp, Rhodobacter sphaeroides ATCC 17029
atgtgcgtcggggatccgctgcgcctgatcgcggtcgagggcattgccggcaccgtcgaagacggggcgggcacctgcctgatcgatctcagcctcgtgcccgaggcacggccgggcgactggatcctctcctttctcggcaccgcccgtgcggtcatcgccgcggacgaggccgcgcggatttcggccgcactggcggcgctgcgctcggtgatgatcggcgggccggtcggagacgccttcgccgatctcgaccgcccgccgtcgcttcccccccacctgcaggccgcgctcgacgcgggccgcaaccacggatga

SEQ ID NO: 8178 - DNA, 309 bp, Rhodobacter sphaeroides ATCC 17025
atgtgcgtgggggagccccaccgcctcgcctccgtcgaaggcatcgcgggcaggaccgaggacggcacgctgatcgacctcagcctgacgcccgaggcgcgcgccggcgactgggtgctctgctttctcggtgccgcgcgcgaggtgattacggccgacgccgccgcgcggatcgccgacgcgctcgcagcgcttcgggccgtgatggcgggcggcgaggtgggcgcggcctttgccgatctcgaccgtccgccgagccttcccccccaccttcaggctgcgctcgacgcaggccagagccacggatga

SEQ ID NO: 8179 - DNA, 333 bp, Xanthobacter autotrophicus Py2
atgtgcctcggcctgcccatgcgcatcgaggaggtggagggcagcttcgccctgtgccgcgccgagggcgcccgcgagcgggtggatcttgccctggtgcccgaagcgcgcaccggcgaccatgtgctcgtcttccagggcaccgcccgtcgcctgctggacgctgacgaggcgcgcctcatcaccgaggcgctcgccggcgtcgccgccatcatggcgggggaggcggatgccgcagtcattgaccgcgccttcgccgacctcgccgaccgcgagcccactttgccgccccatctcgccgcggcctatgccgccggccgaaaggaagcctga

SEQ ID NO: 8180 - DNA, 339 bp, Beijerinckia indica ATCC 9039
atgtgcattggcattcccatgcggatcgtcagcttggcgggtgaaaccgcgctctgcgtcgcggaagggcgggaagagcaagtggatctcgccttgctgtccgaggcgaaggtcggggaggacgttctggtctttctcggtcttgcccgccgtgtgctcgaccccgaagaggcggcgcagatccgagcggcgctcggggccctggcggcgctttctcccgcttctggcgaggcgacggtggatctcttgcaggatggtttcgccgatctcatggaccgggagccgcaattgccgccccatcttgaggcggcccgcgccgccggcctggaggaaggttga

SEQ ID NO: 8181 - DNA, 309 bp, Burkholderia phymatum STM815
atgtgcgtcggtattcctgcacgcgtgcgacgcgccaacggtctgcgcgcgcaatgcgaaagccgcaacggaccttgtatggtcgacctgtcgcttacgggaccgcttgctcccgatacgtgggtgttgacgttcctcggcgcggcgcgcgaggtgattgatgaggcgcgcgcacgcgacatcgaatcggccctcgcctcgctcgatgcgatcgcccacggcgaaagcggtcttgacgcctactttgcagatctggccgatcgcgagccagagttgccaacgcatttacgcgagaacattacgcgatga

SEQ ID NO: 8182 - DNA, 300 bp, Salmonella enterica serovar Newport SL254
atgtgtattggcgttcctgtgcaggttatttcacccggtcagtggttcgccaaatgccgcgaccgacacggcgagcttatcgacgttgatattcggcttgtggctccccccttagcaggcgcatggctgctgacatttggcggcgcagcacgacgagaaatggacgaagcggaagccgctgaggtactggcggcgctggactcactggaacaggccatgctcacgcaaagcgatccgctgaccggttttgccgatttattgtctcgcacgcctgaattaccggagcatttaaaaaaatga

SEQ ID NO: 8183 - DNA, 300 bp, Salmonella enterica serovar Heidelberg SL476
atgtgtatcggcgttcctgtgcaggttatttcacccggtcagtggttcgccaaatgccgcgaccgacacggcgagcttatcgacgttgatattcggcttgtggctccccccttagcaggcgcatggctgctgacatttggcggcgcagcacgacgagaaatggacgaagcggaagccgctgaggtactggcggcgctggactcactggaacaggccatgctcacgcaaagcgatccgctgaccggttttgccgatttattgtctcgcacgcctgaattaccggagcatttaaaaaaatga

SEQ ID NO: 8184 - DNA, 300 bp, Salmonella enterica serovar Schwarzengrund CVM19633
atgtgtattggcgttcctgtgcaggttatttcacccggtcagtggttcgccaaatgccgcgaccgacacggcgagcttatcgacgttgatattcggcttgtggctccccccttagcaggcgcatggctgctgacatttggcggcgcagcacgacgagaaatggacgaagcggaagccgttgaggtactggcggcgctggactcgctggaacaggccatgcttacgcaaagcgatccgctgaccggttttgccgatttattgtctcgcacgcctgaattaccggagcatttaaaaaaatga

SEQ ID NO: 8185 - DNA, 300 bp, Salmonella enterica serovar Agona SL483
atgtgtatcggcgttcctgtgcaggttatttcacccggtcagtggttcgccaaatgccgcgaccgacacggcgagcttatcgacgttgatattcggcttgtggctccccccttagcaggcgcatggctgctgacatttggcggcgcagcacgacgagaaatggacgaaacggaagccgttgaggtactggcggcgctggactcgctggaacaggccatgctcacgcaaagcgatccgctgaccggttttgccgatttattgtctcgcacgcctgaattaccggagcatttaaaaaaatga

SEQ ID NO: 8186 - DNA, 300 bp, Salmonella enterica serovar Dublin CT 02021853; identical to SEQ ID NO: 8183

SEQ ID NO: 8187 - DNA, 321 bp, Azotobacter vinelandii DJ
atgtgcatcggtattcccctgcgggtgctggaatgcgcgccgggccgcgccctgtgcggcgacgagaacggcgtgcggtggatcgacacgcggctggtcgagccgccggcgcccggcgactggctgctggtgttcctcgacgccgcccgcgaaatcctcgacgccgggcgcgccgcgcggatccgcgaggccctgcgcgcgctgcaggccgtacaggcgggcgatccggccgcgctcgccggcctgttcgccgacctcgaccgcgagccgcaactcccgccccacctgcaggcgcaactgccgcccaaggaaccgacatga

SEQ ID NO: 8188 - DNA, 192 bp, Methylococcus capsulatus Bath
atgagtgaaggagcggaagaactgaaggccaaactgaagaaactcaacgcccaggccacggcgctcaaaatggacctgcacgatctggcggaggacttgcccaccggctggaacaggatcatggaagtcgccgaaaagacctatgaggcataccgccagctcgatgaattccgtaagagcacggccagttag

SEQ ID NO: 8189 - DNA, 216 bp, Anabaena variabilis ATCC 29413
atgcaaatagaagaaacaacgattgaggaaatacaaagcaaaatcaaacgccttaatagtaaagctgggcaaatgaaaatggatctgcacgatttagcagaaggtttgccaacagattacacccaactgatggacgttgcggcggcaacttatgaaatttatcgtcagctagatgaactcaagcaagagttgaagaaattggagaacactaaatga

SEQ ID NO: 8190 - DNA, 249 bp, Anabaena variabilis ATCC 29413
atggtgcagtcagccaaaacagattctgtcaatcaacagacgattgaagggttaaaactacaaattaagaaactgaacagtaaggctggtcaattgaagatggatctgcatgatttggctgaaggtttgccaattgattaccaaaatttgactgcactagcagccgaaacttatgaaatctatcgtcatttagatgaattaaagtctcagctaaaaagtttggagaaaaatcatgacatgggatattga

SEQ ID NO: 8191 - DNA, 267 bp, Frankia CcI3
atgactcctgacgcccaagccgccgacaccccggccgccgacgcccaagccgccgacaccccggcagggggcgccccggccgacaccgagctgcggctgcgcaagcttcgcagccgggcctcccagctcaagctcgacctgcacgacctcgccgaggacctcccgatcggctgggagggcctgctcgacgccgcccgccgcacctacgacgcctatgcggagatcgccctcctcgagggcctgctcaagaaggagacatcgcgatga

SEQ ID NO: 8192 - DNA, 207 bp, Rhodopseudomonas palustris HaA2
atgtccgatatcgacgcattgaaggccgaactgaagaaactgtcggcgcgcgccacgacgatgaagatgaacctgcacgatttgtcggaagaactgccgatcaactggcagaacatcatgaccgtcgcgcagcagacccacgatgcctatgcggcgctcgaagccgcgcgaaaagccttgaaggagctggaagccaaggccgcctga

SEQ ID NO: 8193 - DNA, 207 bp, Rhodopseudomonas palustris BisB18
atgtccgacatcgagacgctgaaagccgaaatcaagaaactgtcctcgcgcgccatcaacgcgaagatgaatctgcacgatctgtcggaggaactgccggtgaactggcagaccatcatggccgtcgcgcaggacacccacgacgcctatgcggcgctggaagccgcccgcaagaccttgaaagagctggaagccaaggccgcctga

SEQ ID NO: 8194 - DNA, 207 bp, Burkholderia xenovorans LB400
atgagtaccgatgccgacgaactgaaggcgcgcctgaagaagctgaacgcgcaagcgactcaggcgaagatggatctgcacgacctctccgaggaactgccgaccaactgggagaacattcttgctgtcgcccagcgctgccacgacgcgcatgccgcgctaatggccgctcgcgcagccgctgccgcggccgcggccgctgcctga

SEQ ID NO: 8195 - DNA, 207 bp, Rhodopseudomonas palustris BisB5
atgtcagatatcgacacgctgaaagccgaaatcaagaagctgtccgcgcgcgcgacgacaatgaagatgaatctacacgatctgtcggaggaactgccgatcaactggcagaccatcatgacggtggcgcagcagacccacgatgctttcgcggcgctcgaagccgcgcgaacaaccttgaaggaactggaagccaaggctgcgtga

SEQ ID NO: 8196 - DNA, 201 bp, Polaromonas naphthalenivorans CJ2
atgagcacggatgccgacgaactcaaggcgcgcctgaagaaactcaacgcgcgcgccacgcaggccaagatggacctgcacgacctgtccgaagacctgcccaccaactgggaaaagattcttgaagtttcccagcgctgccatgaagcccatgccgcgctgatggaggcacgcaaggaggctgctgcggcagcaggctga

SEQ ID NO: 8197 - DNA, 201 bp, Bradyrhizobium BTAi1
atgagcgatttggataccctcaaggccgagatcaagaagctgtcggcacgcgccatggatgccaagatgaacctgcacgatctgtcggaggaattgcccatcaactgggaccagatcctgccgacggcgcagaaggcgcatgaagcgttcgccgagctggagaagaagcgggccgagctgaagaagcttgagactgcgtga

SEQ ID NO: 8198 - DNA, 201 bp, Xanthobacter autotrophicus Py2
atgagcgacgtggaagaactcaaggccgaaatcaagaagctgtccgccaaggcgacgcaggcaaaaatggacctccacgatctgtccgaggaactccccatcagctgggagacgatcatggatgtcgccaagagggcgcacagcgccttcgccgagctggaaaagaagcgcgcggacctgaaggcacttgaggccgcctaa

SEQ ID NO: 8199 - DNA, 264 bp, Frankia EAN1pec
atgactcctgagaccagcaccagcaccagcactgatgccggcaccgatgtcgccgccgtccagacccggctgcgcaagctgaacagcaaggcctcgcagctcaagctcgacctgcacgacctcgccgaggacctcccgatcaactgggagaacatcctcgacctcgcccgccgtacctacgacgcctacgccgagatcgcgctgctggagaacgagctgcgcgccagcgccgccggtggcaccgggaagggagcgggagcatga

SEQ ID NO: 8200 - DNA, 201 bp, Leptothrix cholodnii SP 6
atggctgacatcgacaccctcaaggccgagatcaagaaactcaacgctcgcgccacgcagtccaagatggacctgcacgacctgtccgaagacctgccgacgaactgggaaaagatcttggacgtcgccaggaccgcccacgacgcgcatgccgccctgatggccgcgcgcaagcagctggcggacgcaacccccgcgtga

SEQ ID NO: 8201 - DNA, 201 bp, Beijerinckia indica ATCC 9039
gtgagtgaagttgacgaattgaaggccgaaattaaaaagctttcagccaaggcgatgcaggccaagatggatctgcatgatttgtcggaagaactccccatcaattggcagcagattctgagcgttgcgcagcgcgcccatgaagcatttgaaacacttgaaagcaagcgggccgaattgaacaatagttcggcctcttaa

SEQ ID NO: 8202 - DNA, 207 bp, Rhodopseudomonas palustris TIE 1
atgtccgacatcgagacgctgaaggccgagatcaagaaactgtccgcccgcgcgaccacgatgaagatgaacctgcacgacctgtccgaggagctgccgattaattggcagaccatcatgacggtggcgcaggaaacccaggatgcctacgcggcccttgaagctgcgcggaaggctttgaaggagctggaagcgaaagccgcctga

SEQ ID NO: 8203 - DNA, 264 bp, Acidithiobacillus ferrooxidans ATCC 53993
atgtctgtattgatggagatgttaccgatagtagaagaacagaccaatcactgggagttgattgtggacgaaaaagacgctttgaaaacagaaatcaaacggctcaatgcccaggccacccaggccaaaatggatcttcacgatctggccgaagatttgcccgtcggctgggagaatattctggaactggcgaaccgtacctacgctgcctatcgcgacctgacggtggccagggcgcggctcgcatccttccctgggggatga

SEQ ID NO: 8204 - DNA, 198 bp, Methylobacterium sp. 4-46
atgtccgacatcgagaccctcaaggccgagatcaagaagctgtcgtcccggtccgtcaccgccaagatgaacctgcacgacctctcggaggacctgcccaccaactggcagtcgatcctgcgcgtggcgcaggagacctacgacgcgttccaggccctcgacgcggcgcgccgcgccctcaaggccgccgaggcctga

SEQ ID NO: 8205 - DNA, 210 bp, Gluconacetobacter diazotrophicus PAl 5 JGI
atgacggatatcgcggaactgaaggcggaactgaagaagctgtccgcccgggccaccaaggcgaagatggatctgcacgatctgtccgaggacctgcccgtcaactggcaggcgattcccgacatcgccgcgcaggcgcatcgggcctttgccgaactgaccgaaaaacgcgcggcgctggccgcgatcgaagacgcgacgaaggaatag

SEQ ID NO: 8206 - DNA, 201 bp, Methylocella silvestris BL2
ttgagctccatcgacgaagtcaaggccgagatcaggaagctctcgtccaaggcggtcaatatgaaaatggcgcttcacgatctatcggaagatctgccgatcaactggacgaccatcaacgacgtcgcccagcagacttatgacgcttacaaggctctcgaagacgcccgcgcgcggctcaaggctctggaggacgcgtga

SEQ ID NO: 8207 - DNA, 237 bp, Cyanothece PCC 7424
atggttcaactcacttcaaaaaccccaactccagaagccgtagccgaacttaaaacttatattcggcgacttaacagcaaagccggtcaaatgaaaatggatctccatgacttggcagaaggtttacctacagattatcaaaatctcttagaggtagcgaccaaaacttacgatatttttcgtgagttagatcaactcaacaaacaactcaaacaatgggaggaacaactcaaatga

SEQ ID NO: 8208 - DNA, 231 bp, Cyanothece PCC 8801
atggtagaaacaacaaccagtaaaccaacagcagaagagatagacgatctcagaaaatccatcaaacgactcaattcagtagcgggtcaaatgaaaatggatttacacgatctagcagaaggattaccaacggattatgaaaacttgctagacactgctcagaaaacctacgacatttttcgtcaattagacaccctaaaaaaacaactcaaaacttgggaggaactgtaa

SEQ ID NO: 8209 - DNA, 264 bp, Acidithiobacillus ferrooxidans ATCC 23270; identical to SEQ ID NO: 8203

SEQ ID NO: 8210 - DNA, 255 bp, Cyanothece PCC 7425
atggccatcagcccgatcgtcgatgctacacctgcacccacccattgccccagtgcggaggagttgcgatcgcaaatcaaacgcctaaacagcaaagccggccagatgaagatggatctgcacgacttagccgaagggttaccgaccaactatcaacaattgatggaggtcgccgcccaaacctacgccatttttgagcaactggatcagttaaagcagcaactaaaagttctggaacagaaggagaagaattaa

SEQ ID NO: 8211 - DNA, 540 bp, Methylobacterium nodulans ORS 2060
atgtccgataccgagaccctcaagaccgagatcaagaagctctcggcgcggtccgcaaccgccaagatgaacctgcacgactctgcggaggacctgccgaccaactggcagagcgttccagccgtggcgcaggagacccacgacgccttcgcggcgctggacgcggcgcgctctgaaggccgccgaggtcgcggcggcctgaccctcatcggaaggaaccccgccatggcctttacaacgcgcgacggccgcgcctggataccggacttcctcgtggccatcgacgagactacctgcatcggctgcggccgctgctataaggtgtgctcgcgggacgtgatgcatctgttcggcgtcggcgacggcaacctgctcctcggcaagatcgaagaggacgaggatgacgacttcgacggcgagcttgtccgcaaggtcatggtggtggacaatgccggggcctgcatcggctgcggggcgtgcgcccgggtctgccccaagaactgccagacccatgtccccgccgaccggatcgcggcctga

SEQ ID NO: 8212 - DNA, 231 bp, Cyanothece PCC 8802; identical to SEQ ID NO: 8208

SEQ ID NO: 8213 - DNA, 456 bp, Brucella suis 1330
ttggaactgttggatgtcattcatacgcgggcgcaggctttcgaggctttgaagcgtattgcggcgcgccatgggcggcctctcaatcccgatgctctcgtgcgtcttacacaccgcgccgacaagaagcggcgcgagcgatgcatcgaattatgcgaggcactgatcgatcttctggctgcctcttttggtgccagcggtgcggaaatccgctcaccgcttcgcggacggcaggaagtctcacgtatccgtcagatcggcatgtatgtggcccatacatcgctgggaatggctatgaacgaagtggcgctgggctttgcgcgtgatcgcacgaccgtcatgcacgcctgccatacggtggaggatttgcgtgatgacgtagagttcgatgccctcgtttccctgtttgaaaaaatcgttaattcgacttttacggcgtggaggatggcagcatga

SEQ ID NO: 8214 - DNA, 396 bp, Rhodopseudomonas palustris BisB18
atgctcgacacgccctgcgcgattgcaccatcgtccgcgccgcccggccagccgccatcgcccgatcagatcgtgcgccgggtggtggcctgcgtcgccgccgatttcgggctgagcgtcagcctgctgaccggcgcgccgcgcggttcgccgcgcatcgcactggcccgccagatcgcgatgtatctcagccatatcggcttcggactgagcttcgaggcgatcggccggctgttcggccgcgatcgcaccaccgtggcgcatgcctgccgggtggttgaggacagccgcgacgacgtctggatggatggccggctggccacgctggaacggatctgcggcaccgcaacgcccgaaccggccgcaagccgccgcgccgcgggggcgcgacgatga

SEQ ID NO: 8215 - DNA, 426 bp, Mesorhizobium BNC1
gtgcagtccatcgcggcaagtcagttgcaggaaaagcaagacaaggatgcaggggttgcggctcggcaggacgcccttgggcgcaagctgagcccgatatgtgacgagagggtaaatgatatttgcgagtgcgtgatggatatcgttgcagcgctcttcaatgtcagcgggaaggagataaggagctccgggcggagctctacgcaggtggcgcgtgtgcggcagatcgggatgtatgtggcccatgtggtcctgggtttgagcatgaaggagattggccgcgggttcggccgcgaccgcactacggtgcagcatgcctgccatttgatcgaggacatgcgcgacgatgtggaattcgatcagatcgtgctggtcatcgagcgggtaactgccgctgctttccggcatacggaggtgctgggatga

SEQ ID NO: 8216 - DNA, 387 bp, Maricaulis maris MCS10
atgagccgtatcatgtgcagactggaagaggatgtcgcccgggcccgcctggcccagagcgccgtggcttacgccttcgggatctcgcagcgcgagctggaggcaccgacccggcgatcgcgggaggccgctctggccaggcaggcggcgatgtatctggcccatgttgccttcgagctgccgctgacccgcgtggcgctcgccttcgggcgcgaccgcacgacagcggcccatgcctgtcatcgcatcgaggaccggcgcgatgaccgcgcctttgacgactatatggacgcgctggaagccgccctgcgcaccgcgccgcgactgagcgggctgcagcgtctggccggtctggaacgttttgaacgcccggagcgcctgacatga

SEQ ID NO: 8217 - DNA, 456 bp, Brucella ovis
ttggaactgttggatgtcattcatatgcgggcgcaggctttcgaggctttgaagcgtattgcggcgcgccatgggcggcctctcaatcccgatgctctcgtgcgtcttacacaccgcgccgacaagaagcggcgcgagcgatgcatcgaattatgcgaggcactgatcgatcttctggctgcctcttttagtgctagcggtgcggaaatccgctcaccgcttcgcggacggcaggaagtctcacgtatccgtcagatcggcatgtatgtggcccatacatcgctgggaatggctatgaacgaagtggcgctgggctttgcgcgtgatcgcacgaccgtcatgcacgcctgccatacggtggaggatttgcgtgatgacgtagagttcgatgccctcgtttccctgtttgaaaaaatcgttaattcggcttttacggcgtggaggatggcagcatga

SEQ ID NO: 8218 - DNA, 453 bp, Ochrobactrum anthropi ATCC 49188
atgtctttggaactatcggatgtcattcatacacgggcggaagctttcgaagcattgaagttgcttgcggtgcggcatgggcgaagccttaaccttggaagggtggagggtgtcgccgaccggtcgcgggagcagcagaacatagcgctgtgcgatgcccttattgatctgctggtgactatgttcggtgtttccggcgcggaattgcggtcaccactgcggtgcaggcgagaggtggcgcgtgtgcggcagatcggcatgtatgtcgcgcacacggctttcgggctggccatgcgtgaagtggctgccggatttgcgcgagaccggacaaccgtaatgcatgcctgccatctggtggaggacatgcgcgacgatacggagttcgatgcgatcgtctcgacattcgaacgcattgcgcaaagtgctttcacggcctggaggttggcggcatga

SEQ ID NO: 8219 - DNA, 411 bp, Parvibaculum lavamentivorans DS-1
atgaaggaacgttctttttttgttctttggtgggagcgggcaatggattggcaaaatttcgcggaaagcggctgggtggcgggcactatcaaccgggtgcaggcggcccaggtggccttgatgcaggaaacggtggcgcgggcctggaacgtgccggtggacgaaatacgctcgccgacgcggcgcagggcacccgtggcgcaggcgcggcaggtggcgatgtatctgacgcatgtgctttacggcttcagcctgtcggcggtcggccggcatttcggacgcgaccggacgacggcggcacatgcctgccggctggtggaggaccggcgcgacgacgagaatttcgacatgctgctggaccggctggaacacgcgctgcgccgcgccggcgcagcgcaggcgctgcagtga

SEQ ID NO: 8220 - DNA, 393 bp, Xanthobacter autotrophicus Py2
atgtcttaccagccggtcgagccccacgccgcctgcgcacaggccccgtcccgcccatcggtcgccgcgacccctgccttgtctggaacgaccgggcccacttcctgccggctggcgacggccatcgtcgccgccatggccgggctcaatgtggatgccctggtggacctgcgccgatccaccgcgccggtggcgacagcgcggcagatcgccatgtacctcgcccatgtgggcctcggcctgtcgcaggcgggggtggcgcaggcgttccggcgcgaccgctccaccgtcgcctatgcctgccggcgcatcgaggacctgcgggacgatcccgccttcgaccaccgggtggcccagatggaggcctgcctgcgctgggccacggagcgctga

SEQ ID NO: 8221 - DNA, 387 bp, Caulobacter K31
atgctggctcaagttctcgaggatctgtgggcgatatcgcccgacccgcgccgcgacaagttggcggcggctttcatcacccacgcggtggccctggccacgggcgtcgcgccggccgatatcgcctcgagcaagcgcaccagcaaggctgcggcgcgggcgcggcagatcgccatctatctggcccatgtcaatttcaactggccgctgatccgcgtggccttcgccttcaaccgcgaccgcaccacctgcggctacgcctgtagccgcatcgaggacatgcgtgaaaacgccgacttcgacgcccggatgaccgtgctggaggcctgtgtgaaacaggcgccggaaacgcttccggaactgacccggatcggggttgaccgatga

SEQ ID NO: 8222 - DNA, 366 bp, Agrobacterium vitis S4
atgtcagcaatgccgcttgaacatcctgtcccggtcaaagcctccagccgggttctgtgccattccgttgccagggttacggaggaaatatttgtggtttttcagagcccgggtctcataaatgccgggcgccgccgtcagcgctgccatatccgccagatcgccatgtatctctgccatgtggtgctgagcctgccacagcaggaaatcgcccgcgctttcggctatgaccgaagcacggtatcccatgcctgccatgtcattgaggatcggcgcgaaaatgccgccctcgaccagtttctcggcgttttggaacgggtcgtcgcggtgctgtcgacggtggccaaggatgggcgcgatgcgtaa

SEQ ID NO: 8223 - DNA, 222 bp, Enterobacter sp. 638
atgggactgaacatggaaaaaatcacgacgtttgtcgcctactggctggccgtgggggtggcgtatttcggggcgatgtcccctgaaaagctggcgctgtatgtcggcggtggctgcgccatttttaccgcgctgaccaattactggtttaagcgcaaaacctatcgctatctgatttcgctcggactcgataagggggctattcgtgagctcaatcattaa

SEQ ID NO: 8224 - DNA, 216 bp, Escherichia coli HS
atgacgcttgagcgaatcagcgcctttatcacgtattgcatcgccgtcgtgctggcctggctgggcgatttgtccatcaaggatgcctcaacgctgggcggcctgatgattggtgtgctgatgctggctatcaactggtactacaaacacaaagcctaccagcttctgcgcgacgggcagatctcgcgggaggactatgaatccatcaatcgttaa

SEQ ID NO: 8225 - DNA, 219 bp, Serratia proteamaculans 568
atggaaaaactcacctcaacgcttgcctacctcacggcggcctgtctggcctggatggggcgacattccacacaggacattgccctcttggtcggcgctgcggtcggtgtcggtactttcgcagtgaattggtactaccggcgtaaaagttaccagctgttgaaatcgttaaaaaaaaacggtctgaaacgcggagtctacgatgagctcactcgctaa

SEQ ID NO: 8226 - DNA, 216 bp, Escherichia coli C ATCC 8739
atgacgcttgagcgaatcagcgcctttatcacgtactgcatcgccgttgtgctggcctggctgggcgatttgtccatcaaggatgcctcaacgctgggtggcctgatgattggtgtgctgatgctggctatcaactggtactacaaacacaaagcctaccagcttctgcgcgacgggcagatctcgcgggaggactatgaatccatcaatcattaa

SEQ ID NO: 8227 - DNA, 210 bp, Salmonella enterica serovar Newport SL254
gtggataaaatcacaacctttctgacctactggctgtcagtggtgctggcgtatttcggtacgcagacaccggaacggctcgcgctttatgtcgggggaagctgtgccatttttaccgcgctggttaacttctggtaccagcgaaagaaataccgctatctcgtctcgatggggattgataagggggttattcgtgggctcattcgttaa

SEQ ID NO: 8228 - DNA, 216 bp, Salmonella enterica serovar Agona SL483
atgacgcttgaacgaatcagcgcctttatcacttactgcattgccgtgctgctggcatggctgggcgatctgtcgctcaaggatgcgtcaacggttggcggcgtactgattggtgtgctgatgctggctatcaactggtactacaaacaccagtctttcaaattgttacgtggcggcaagatttcgcggggggaatatgaatccttcaatcgttaa

SEQ ID NO: 8229 - DNA, 216 bp, Salmonella enterica serovar Dublin CT 02021853
atgacgcttgagcgaatcagcgcctttatcacgtattgcatcgccgtcgtgctggcctggctgggcgatttgtccatcaaggatgcctcaacgctgggcggcctgatgatcggtgtgctgatgctggctatcaactggtactacaaacacaaagcctaccagcttctgcgcgacgggcagatctcgcgggaggactatgaatccatcaatcgttaa

SEQ ID NO: 8230 - DNA, 210 bp, Pectobacterium carotovorum PC1
atggaaagaatcacgtcgtttatcgcgtactggataagcgtcgcgctggcctttttcggcgccatgacgccgcaggatttcgcggcctatttcggggcgctgggggtggtgttcaccgtcggtgttaactggtactaccgccgcaagagttaccagctattgaagactatcggtaatccccgcgaggctatccatgaaatcactcgttaa

SEQ ID NO: 8231 - DNA, 333 bp, Nitrobacter winogradskyi Nb-255
atgacgcgttccgttgctcttgccctcgcaaccggcatcgggcttgcggcgagcctgtacacctgcgcctcgacgacggctaccgcagggccgctttcctacgaactgccgcgcgagacgatcgaattcaagccgggaccaaatctcgacgtcgtgaagaacaactgcctggcctgtcattcagcggattacatcgcaacccagccacgcggcccgaagttcgggaaggatttctggcaggcggaagtcaacaagatgatcggggcgtacggcgcgcagatcgacgaggccgatatcggcaagatcgtggattatctggctgctacgtattga

SEQ ID NO: 8232 - DNA, 333 bp, Nitrobacter hamburgensis X14
atgatgcgtccagttcttctcgccctcgcagtcgccatcggactggccgggggcatcggcgccttcgctccgaccacggccggcgccaagccgatcgcctacaagcttcccgataaagcggcggagttcaaaccggggcccaatctcgatgttgtgaagaacaactgcacggcctgtcattcggcggactacgtccagacccagccgcgcggcccgaaattcacaaaggatttctggcaggcggaagtgaacaagatgatcaaggtgtacggcgcgcagatcgaggaggccgacatcggcaagatcgtcgactatctgactgcgacccattga

SEQ ID NO: 8233 - DNA, 657 bp, Deinococcus geothermalis DSM 11300
atgaagtatcccctgctgatgggcatgctgttcccggtggtggcgttggccgtggccctcccgctctccgtgctgattctccccaccccgacagtcactgggcaaacaacagctgggcagatcgccgcaccgccaagcccagcgtccgcggccaccgcatctccaccgagcacctcggtcaccacgccgtctgtgccgcgcacccagaccgcttcagcggtaccggccactcggcctgtgcccacaacgtctgcggccaccacccgtcctgcctccgccgagttcactcctgttcagtacgccgaacaggtgcgtggcgtgattgatcggatcaccaatggtccctacaccaccgacagttcttacgccatcggtagtgttccgcaagacaccccggcgctggcggacggcgagaacgtggacctggtgcgcgccacctgcagcgtctgtcacgccaccaccttcattacgtcacagccgcccctacccgccgccacctggcacgacgaggtgtacaagatgaaggagaagtacggcgcgaccttcatcagtgacgagaacgccgacaagatcattgcgtacctcagcgcacactacacgccggagacccgccgggcggagacgccggacgccgtgcgccctgccgggcagccctga

SEQ ID NO: 8234 - DNA, 468 bp, Polaromonas naphthalenivorans CJ2
atgaagaaatccagaccgcctttactgcccgccgcgatgctggtttttggctttgtttgcggcgcggcgatggcgcagccggcatcgttgaagccgctgaccatcaagctgccgcccgagaccgccaggctcaagccatctgccttgcccggttaccaggccgccctgcagaagtgcggtatctgccactccgccgactacatcaatctgcagtcgcccgccatgacgcagccgcagtggactgccgaagtgcgcaagatgcagcacgcttacgccgcgccgctgactgacaaggaagtcgctgacattggcgagtaccttgcggtcacttatggtggagccaaaacctccggcatggctgttgtggttccgccgcctgtcaacaccgcagccaaggccgtggacgtccaggcgctgctgacggcaaacgcctgcctgggttgctcaataagtgaaatcacgcgttag

SEQ ID NO: 8235 - DNA, 312 bp, Polynucleobacter necessarius asymbioticus QLW P1DMWA 1
atgaaaaaattaattcttgtttcagctgcaataactatttcagccttttctcaggcaaaaaccattgaaatgcctgctgactcagtagtttggcgcaaatctgatttgccgggatatcagctagtgatacaaaagtgcactacatgtcactctgctcactatgctgaataccaaccgcccaatactggcgttggttattggaacactcaagtcttgagaatgaaaaatgttttcaaggctcccattacagatgaagaagtaccaatcatcgttcaatatttaaatcaaacctatggggccaacagaaaatag

SEQ ID NO: 8236 - DNA, 351 bp, Acidiphilium cryptum JF-5
atgaagatcatcagcacatattccgcgcgcgccgctcttgttgcgctcgcggcggcgaccgtctgcggcaccattgcactggcggctgcacccggaccgacgctggggccgctctcggtcaacgttccttctccgggtggctatttccagggcacgggggcggaaatcctgaaccagcactgtgtcacctgccactcggcgggattcgttgagcggcaaccgaagctttccgcatcgacctggacagtggaggtgacgaagatgaagaaagcgttcggcgcgccctacgcggaggccgacatcccgaagatcgtcgacgcgctggtggcccggcagaaggcgatgaaatag

SEQ ID NO: 8237 - DNA, 339 bp, Sphingomonas wittichii RW1
atgcgtgaccggacctggctggccgccggactctgcgccctcgtcgccgcgatcgcgctctcggccggatcgcgcgccgcgccgcgcttcgccatcacatcgacctcggtcgagctgccctatgacgagacggcctatcccgaggggccgggggcggaggtgatgaacgccaattgcgcgtcgtgccattcggcgagcatggtgctgctccagcccagattgtcgcgcgagcaatggaccgggatcgtccgcaagatgcgcgacgtctaccgcgcccccgtcgccgacgaggacgtcccggcgatcatcgactatctggcgaagctatcgccgagctga

SEQ ID NO: 8238 - DNA, 321 bp, Xanthobacter autotrophicus Py2
atgatcaagcatctcaaatccctcgccgccgtggctgtcgccggtaccgtcgccgggcctctcgcgagtatggtggtggccaagcccttgacctacgagctgcctgaggaaacctcggtgttcaagccgggaccgggcatcgagtcggccgagaacaattgcgccgcctgccattcggcggactacatcaccacccagccaccgcacatgggacggccgttctgggaggctgaagtccacaagatgatctcggcctaccatgcgccgatcgacgacaccgacgccaaggcaatcgtcgattacctggcagcgacctattag

SEQ ID NO: 8239 - DNA, 336 bp, Xanthobacter autotrophicus Py2
ttgcagcatagggaggaaaccatgagacacaaagttaaaatcgtttcggtgagcttccttgcagtagccttggccggtgcggcgctggctgcgccgaagacctatcagctcccggacgagacagccacgttcaggcccggatctggccccggtttcgaggctgcccagaacaactgcgcagcctgccattcggccgactacatcaattaccagcctccgaagaagggcaaagcgttttgggaagcggaggttcacaagatgatcaaggtctacaaggctccgatcgaagaaaacgacgccaaagccattatagaatatctctcaaatacatattga

SEQ ID NO: 8240 - DNA, 318 bp, Methylobacterium radiotolerans JCM 2831
atgcgggcgctcgtgctcggcgcggtgatcgcgggtctgacggccggcgcggcctgggcggcgccgcggacctacacgcttccggacccgaccgcgcagctgcggcccccgacggacgggggcctgaccgcgggctacgaggcggcgcaggccaattgccagacctgccactcggtcgactacatcgccacgcagccgcccgggcgcgggaaagccttctgggatgccgaggtggccaagatgatcaaggcctaccacgccccgatcgagcaggccgacgccggcgcgatcgccgcctatctggccagaacctactga

SEQ ID NO: 8241 - DNA, 339 bp, Methylobacterium radiotolerans JCM 2831
atgaacccgatccatccggcagccctcatcgccgcactcgccctgtctcccctggtcgcgctcgccgccccggcccccgagccgatgcgcttcacctcgcaatcgatccagatgccgacctccgaccggatcttccccgacgggccgggggccgaggcggtcaataacaactgcctcgcctgccactcggccgggatggtgctgacccagcccaagctcacgaaggcgcagtggaccgagaccgtgaacaagatggtccacgtctacaaggcgccggtcgatcaggccgacgtgcagaccatcgtcgactacctcacggcgttgaagccgacgccctga

SEQ ID NO: 8242 - DNA, 435 bp, Burkholderia ambifaria MC40 6
atgaacgcaagactgaagcgcatggcggtgatgttgatggtccccgtttccgttggtgcgttgcttggcctcgtgggccggcactaccttcccgagtccattgcggcgcaggcggcgcgccaggacgccatcgcgccgccggtgcacttgagcgcgctcaacgtgacgttgccgcccggccattcggtgtttccgcccgggcccggtgcggacatcgccaacgcgaattgcgtgatgtgccactccacgggcatggtgctgcggcaaccgccgctcaccaccagcgaatggaaggtcgagatcacgaagatgcgcaatgcgttcggcgcacctatttcaccggaccagatcgacgcgctggcgcattacctgaacgccatcgatggccgcaagcctcaggcgggcccgtccggcgtcgacaatcaggcgagctga

SEQ ID NO: 8243 - DNA, 279 bp, Sulfurihydrogenibium YO3AOP1
atgaaaaaatttattacaattatattaacaatattttctatatcttatgccggagaagaaaatttggtattaaaagaaggaaaaaataaagagttggctcaagcttactgctctgcgtgccatagtgttgactatattataatgaattcaatgtttttagacaaaaaaggttgggaagcagaattagataaaatgattaaacttggtgcgccaataagcaaagaagattcaaaaaagataattgactatcttgtcaagaactacggaataaacaaataa

SEQ ID NO: 8244 - DNA, 318 bp, Methylobacterium sp. 4-46
atgcccacgataccgcgctccgcgctcctcgccctcgccgccctcacgatcgccctcggggcggcccgggcggcgccccgaacctacgcgctgcccgagggcgccgccgcgctgcgccccgggcccgagcccggcttctcggccgcgcaggcgaactgcctcacctgccactcgcccgattacctcgccatgcagccgcccgggaagggtcgcgccttctgggacgcggaggtgaccaagatgatcaaggtctaccgcgccccgatcgacgaggccgacgccaaggcgatcgccgcctacctcgccgcggtgtactga

SEQ ID NO: 8245 - DNA, 321 bp, Methylobacterium chloromethanicum CM4
atgaaccgcatcaccgtcgccctgacggcaaccttcgccctcgctgctggtgcggcgctcgccgcgccgaaatcctacgaccttcctgagccgaccgcgaccctgcgggcgccgaaggccagcacgcacgcgggaggcttcgaggcggcccagacgaattgcctagtctgccactcggtggactacatcgcgatgcagccgccgggcaaaggcgcggccttttgggaatccgaggtgcacaagatggtcaaggtgtatcacgcgccgatcgacgaggcgcaggccaaggccatcgccgcctacctcacggctacctattga

SEQ ID NO: 8246 - DNA, 324 bp, Methylobacterium nodulans ORS 2060
atgacgaagcgattcctgaccgccgccgcggccgcgggcctgctcgccggaggcgcggcgttggccgggccgcgcacctacgcgctgcccgagccaacggcgcagctgaaggagccgagggacaaggcgcacgcagccgggtacgaggccacgcaggccaactgcctgacctgccactcggtcgactacatcgccatacagccgcccgggaaaggccgagccttctgggacgccgaggtgaccaagatgatcaaggtctacggcgccccgatcagcgaggccgacgccaaggtcatcgccgcctacctggccgcggtgtattaa

SEQ ID NO: 8247 - DNA, 333 bp, Methylobacterium nodulans ORS 2060
atgacatcactaatttcgcgtttggcacttgtgagcctcgctattcttgggctctcgtgcgctgcggcctggatcgaatcggcccgcgccaagcccatgacctatgaccttccggaggaaacttcgaagctccggcccggtgccggagtggaggtcgccgaggcgcattgcctcacctgccactcgccagactacatcgcgatgcagccgggtgggaaaggtcgtgccttctgggcagccgaaatcagcaagatgcttaaggcttacggcgcacctatctcggatgacgatgcaaagacaatcacagattatctcgccactacgtacccatga

SEQ ID NO: 8248 - DNA, 324 bp, Methylobacterium nodulans ORS 2060
atgacgaagcgattcctgaccgccgccgcggccgcgggcctgctcgccggaggcgcggcgttggccgggccgcgcacctacgcgctgcccgagccaacggcgcagctgaaggagccgagggacaaggcgcacgcagccgggtacgaggccacgcaggccaactgcctgacctgccactcggtcgactacatcgccatacagccgcccgggaaaggccgagccttctgggacgccgaggtgaccaagatgatcaaggtctacggcgccccgatcagcgaggccgacgccaaaaccatctcagagtacctagccgacagatattga

SEQ ID NO: 8249 - DNA, 261 bp, Brucella suis 1330
atgaacgcagcaccgccccgaccgccgctcgaaggactgcgcaagcagcttgagaaaagccgcacccgcaaaaaccggatgccgcgcgatgggttcgtgcgggaaaccttcaccttgccacggcaggcggcgcgcaaaaaagcgcgggaatggttcgatactttccccaaggcggcctattggacggaaatcgaaagctggtgcgagcggcctgacgatgtgatcgaattcaccatgcgccgcctggcgacggcggattag

SEQ ID NO: 8250 - DNA, 264 bp, Mesorhizobium BNC1
gtgcgagtacccgccaaaccaccgcttgaagggcttaagcgcagcctcgacaaaaagcgcgcaaagggcgaagccaagcgcctgccgcgcgacggatttgtacgcgaaaccttcgctctgccgcgccaggaagcgcgcgccaaggcccgcgaatggctggagcgctggcccaagcaggcctattggacggaaatcgaaagctgggccgagcgtccgggcgatgtgatcgaattcaccatgcggcgcctgccgagcgcggattga

SEQ ID NO: 8251 - DNA, 261 bp, Brucella ovis; identical to SEQ ID NO: 8249

SEQ ID NO: 8252 - DNA, 261 bp, Sinorhizobium medicae WSM419
atggcgaagatacccccaggaccgccgctggaaggcttgcggcgtcagatcgcccggcatcgccgggaacgacctgcacgaagctccggacttttcgtgcgcgagacgtttcggctcgagcgtgatgccgcgcgagcgaaggcgcgcgaatggttcgagacctggcctaaggctgcctattggacggaggtcgagagctggcgtcagcttgagggcggcgaaatcgagttcacgatgcgccgcctcccgagcgcggactga

SEQ ID NO: 8253 - DNA, 273 bp, Ochrobactrum anthropi ATCC 49188
atgacagcagcaccgccccgtccaccgctcgaaggcttgcgcaagcagctgcagaagagtcgcgcccagaaaggcctgaagcaaagccggatgccgcgcgacggtttcgttcgcgagacattcaccctgccgaggctggcggcacgtgaaaaagcgcgtgaatggttcgagacattcccgaaagcggcctactggacggaaatcgagagctggtgcgagcgcccggacgacgtgatcgagttcaccatgcgccggctggcgactgcggattag

SEQ ID NO: 8254 - DNA, 261 bp, Rhizobium leguminosarum bv  trifolii WSM2304
atgaaaaaagttccagggcctccgtctttcgacggcctgaagcgcaggatagcaagacatcgggcggaaacgtcctcccgccggaaagaccatttcgtgcgtgagacatattgcctcggcctgatcgacgcacgcgccaaggcgcgcgaatggttcgacgaatatccgaaagccgcctactggacagaggtggagagctggcgtcagctcgacggcgaccagatcgaattcaccatgcgccgcctgccttcggccgattga

SEQ ID NO: 8255 - DNA, 279 bp, Agrobacterium vitis S4
atgacaggaaagcgtcctcttccgccgctcgacggcctgaaacggcagattgcccgccaccgtgatcgacagacaaaagaacgggggcaggcgatacgcgatgcctcgcccttcattcgggaaacctttcgcctcaaccgggaagaggcccgcgccaaggcccgggaatggttcgatgcctttcccaaagccgcctattggaccgaagtggaaagctggcggcaattggaaggcgacgccatcgagttcaccatgcggcgtttgtcgtctgcggattga

SEQ ID NO: 8256 - DNA, 261 bp, Rhizobium leguminosarum bv  trifolii WSM1325
atgaaaaaagttccagggcctccgtccttcgacggcctgaagcgcaggatagcgagacatcgggcggaaaatcccccgagcaagaaagaccatttcgtgcgtgagacatattgcctcggcctcacggacgcacgcgccaaggcgcgcgaatggttcgacgaatatccgaaagccgcttactggaccgaggtggaaagctggcgccagctcgacggcgaccagatcgaattcaccatgcgccgtctgccctcggcagactga

SEQ ID NO: 8257 - DNA, 294 bp, Syntrophomonas wolfei Goettingen
atgattatttccaaaacccaattgctaaatgttttgaagatttacaacaaaggcgataacaaggtggaaaaggcacaggctgccagaggggccgcccgggcggacgaactggctatttcccgggagagcaaggttaagcagaaggcaatgcatgctgtccggcaggcggatgatattcgcttggaaaaagtagctgaattgcaggagcagatttccgcaggaacctatacgctatccgatgatgaagtggcggagaagatgatagaaagggttttggtggacaggttaatttag

SEQ ID NO: 8258 - DNA, 294 bp, Clostridium thermocellum ATCC 27405
atgaaaatctgggagggggtcccaaaggtttcaggcatctatgacagcggtaaaaatgtaaacaaagccgaaaaaactgacggtgtgaccggtaaaaaagatgtggtatccatttcaaatcaggcaaaagactttcagacggcaatgaaagcattgaaagaaataccggacataagaaaggacaaggtggaagaattggcacgaaaaattgagtccggcacttacaaagtcagtgaagaagacatcgcagacaagattttaaaatcaatattggacagaaaaactcaaggatga

SEQ ID NO: 8259 - DNA, 276 bp, Thermoanaerobacter sp. X514
atgaaaatttataacaacaacattgaaaaaataatgtcagtttatcgagtagatgcagtagaaaaagttgctagcaagaaagcggagataaaggataaagttgagatatcagaagaagcaattaaacttgcacaaagttcaaatgaatttgaaaagataaagaatcaaaagattgaaaacataaaggcaatgctgagtgctgggacttacaatgtaaaagctgaagatgtggcggatgctattcttaagggaatattgttgaataaaaaaatttaa

SEQ ID NO: 8260 - DNA, 330 bp, Natranaerobius thermophilus JW NM WN LF
atggataaaattagaggggactataatcagtatttgagaacctatcaaaaaagtatctcccaactggataaggtccaaaaaattgagaaaacaggcaagggccggggaggagaaggtgccaagaaaaaggattctctggaacttacaggtctgtctaaggagattaaggtggccagggaaaagatctctcaactggattcacaggagaaagctcgggtcaacgaattaaaagaatccatacaaagtggcacctatgacgtttctggtgacgaaattgccggtaaaatcattgaaactgcccgagaagttcaatttgaccgggaagtataa

SEQ ID NO: 8261 - DNA, 267 bp, Halothermothrix orenii H 168
gtgcgggtaaatgagacacagggtcagaaaataagccagttatatatagaaaagaaaaaagaagttaataagaagaataagatggcgcgtaaagacaaaataaccatttctaataagggtatcaaggtctccgaaataaaacaggaactggcccggattcctgatgtcaggaagaggaaaatagagtccctgaaaaggcagattcaggagggcaattacagggttccggcccgggaaattgccagaaagttaactgaaaatatttaa

SEQ ID NO: 8262 - DNA, 288 bp, Clostridium cellulolyticum H10
atgaaaatttcaggtgatgtttacaatgtttcaaaggtatataacactcaaaaccatattggagctgtcaatcaggtaaactctgtgaagtccaaaaaggatgttatatccatttcggataatgcaaaggaccatcagcttgtttttaaggcccttaaagaggttcctgatatcaggcagaacaaaattgatgagtttaaagaggtttaccgttcaggaacatacaacgtaagcggacaggaaattgtagagaagcttggaaaagcggtgatagacaagaaggtataa

SEQ ID NO: 8263 - DNA, 288 bp, Anaerocellum thermophilum DSM 6725
atgaggatagaagatagaattaggatatttcagatctacacccaaacagcaaaggtaaccagagtagaaaagaagcaggagcctacggcaactgataaggttgaaatatcaagcgaagcaagagattttcaggcaattttgaatgctataaagcaaacacctgatgttcgtgaggataaagtaaatgagataaaaaagaagattgactctggcacatacaatgtatctggaaaagatgttgttgaaaagctaataagagaatacaaagattcaaaaaagaacgagtaa

SEQ ID NO: 8264 - DNA, 264 bp, Geobacillus WCH70
gtgaaaattcatcatataggtccgatgaacgttaatccgtatgagcggcagtttaataaagtggagcggcaagttccatctacaagaaaaaaagatcaagtcgaaatttctgaagcggcgaaagaattacaggaagcgtcgaaatgggaaagcgctcgccaagaaaaagtcgaacggttaaaacaacaagtgcaaaacgggacgtacacgattgacccgcaagcgatcgccaaaagtatcattcactattatcgaaaacaataa

SEQ ID NO: 8265 - DNA, 345 bp, Rhodospirillum rubrum ATCC 11170
atggacctgatttccggtgaaaattaccacgtacgctatgatccgacccgcagtctggtggcgatcagcgggatcctccgcctcaatggcatgtccgaatacgagccgatcaccgccgttctccgccaagccctggcgcagaacgaaatcctgaccatcgacctgaccgaactggaattcctcaacagttcgggtatcgccatgctttcgaaattcgtgatcgaggcgcgcgcccacgaaggaggatcgctcaccgtcctcggctcgaccgccgtcgcttggcaggggaaatccctggtcaatctcaaacgcctgttacccaccctcaagctggacttccagtga

SEQ ID NO: 8266 - DNA, 354 bp, Sinorhizobium medicae WSM419
atgggcaccgaatacatggaaatcaaggaagacgaatatcgcgtttggtcggaaggaaacgacatctatttcgacgggacgatgcgcctgccgagcaccgaggcctatgcgccgatcttcgccctcgtgacgagcgtgctcgaagccgagccggagcgcatgactgtcgatctcacggggctgcagtttcttaattcttcgggaatcaacctgctcgccaagctcaccatcgaagcacgcaaacggccgaacatacagttcactgttcgcggaagctcagaattcccctggcagtcgaaatccctgccgaatcttaaaaaactccatccgggtgtcgacctgaggctaggctga

SEQ ID NO: 8267 - DNA, 342 bp, Anaeromyxobacter sp. Fw109-5
atgaagccgaacaaggcggactactcggtggaggcggggccgtccccgggcacgtggctcctgcgcggggtgatgcgcctcgaatcgcccgaggcctacgcgcgggcgttcgagcccttgatcgcctccctggggaggggcccggccatctcgatcgacctgacgcaggtcgccttcctgaacagctccgggatccgggcgctcgccgacgtgctcctgcaggcgcgcgacaagcgctgccaggtgaagctgttcgggagcgcggcggtcccgtggcagaagaagctcgcgagctcgctcacggccctcttccccgagatcgtgatgcgcgtcgaccgctga

SEQ ID NO: 8268 - DNA, 339 bp, Rhizobium leguminosarum bv  trifolii WSM2304
atggaaatcagcgacgaaaacttccgtgtatgggcggaacagaacgaagtctatttcgacggcgtcttccggctggccggaccggacgcctatgcaccgatctattccttgatttcaggcctgctccacgacgggcacaaacaggtgacgttcaatctgaccggtctcgagttcctcaattcttccggcatcaatctcctggccaagttgaccatcgaagccagaaagatgggcgacctgctgctggtcgtcaaaggcacgcaccaatatccctggcaagccaagtcgctgccgaacctcaagaagctgcatccgcttcttgatttgcggttggcgtga

SEQ ID NO: 8269 - DNA, 345 bp, Cyanothece PCC 7424
atggaaattcaatctgaaaattatcatatttcctacaatcccgcaacaatgatcgttaattttagaggctcattccgcttaaatgggatgaaggattatgagccgatcgttaactttttaaatgaagtcgctcaacaagaaccccctactattattctagacttacagaaattagaatttttaaatagttcgggtattagtatgctatctaagtttatcattaatatgagaaaaaagcaaaccagtaatattgtagttaaagggtctaaaaatattccttggcaagataagtctttaaaaaatttacagcgtttaatgcctaatctagttttagagtttaattaa

SEQ ID NO: 8270 - DNA, 345 bp, Cyanothece PCC 8801
atggaagttcaaggagaaaactatcaagttacctttgattccgatagcgcaacagttacttttgccggctctcttagattgggaggaatggaagagtaccaacctattgttgaagttttaaatcatgttagtgaacaagattatgaggcagttattcttgatgtcaaaaaactagaatttctcaacagttctggcattagtatgttatctaaatttgtcattaatgttcgcaagaaaaatacgaccagtatcttggtcaaaggggcgaaagagtttgcttggcaagaaaaatccttgaaaaaccttcaaagattaatgcctaatttgaacctagaaatggaatag

SEQ ID NO: 8271 - DNA, 342 bp, Cyanothece PCC 7425
atggaaatcaggacgaaggattatggtatctggtacgatccccagcaagagaccgtttattgccagggatttctccgtttggagggcttagatgcctatcaacccatcattaatgtcttaactgaagcgatcgatcagaacaataacttgatcctagatctgcaggaattagaatttctcaacagttctggaattagcatgttatccatgtttattgtcgatattcgcaatcggggcaatgtccaccttaaagtcctgggttccaaaaaagttctctggcagtcaaaatccttaaaaaatttgcaacggctaatgcccgcgattgatctggagtttatttga

SEQ ID NO: 8272 - DNA, 345 bp, Thioalkalivibrio HL EbGR7
atgcattgtttttccggtgagggttacaagatcgagctggacgataccagcaacaccgtgcgcatgagcggcgccctgcgcctgggcggtctgtcggagtacgcccccatctccgagttgctggagaatgccctggatggccgcgaggcactgatcatcgatctgagcgctctggagttcctcaacagttccgggattgccaccctgtcaaaatttgtcatcactgcccgtaatcgcaacgattgccgtctggccattcagggttccaatgccatcgcctggcagggcaagtcgctcaacaacctgaagcgactgatgcccgcccttgagctgaatttcgattga

SEQ ID NO: 8273 - DNA, 339 bp, Rhizobium leguminosarum bv  trifolii WSM1325
atggaaatcagcgacgaaaacttccgcgtatgggctgagaaaaacgaggtctatttcgatggcgtattccggctggcaggaccggacgcctatgcccccatttactcgttgatatcaggcctgctccatgaggggcacaagcaggtgacgttcaacctgacgggtctcgagttcctcaattcctccggcataaatctcctggccaagctgacgattgaagccagaaagatgggcgacctcctgctcgtcgtcaaaggcaccagccaatatccttggcaagcgaaatcgctgccgaatctcaagaagttacacccgcttctcgatttgcgcttggcgtga

SEQ ID NO: 8274 - DNA, 345 bp, Cyanothece PCC 8802; identical to SEQ ID NO: 8270

SEQ ID NO: 8275 - DNA, 267 bp, Shewanella sp. MR-7
atgaaaaagaccatcgtattaaccatcgccggaaccgatttcagcttccacgttacagcccaagaccatagcgattttattgatgcaatggcccgtggcggctcagttaccgcagcatcgtacaactttgccatgcgcaccatcgatggcgaccacaaggacgactttaaaaagctactcgaaagcgcaccaggtgctgaggtgcaaatcgcgggcgaacttaaaaccgagttcgcgccagtgctggaaatcaccgtaaaaaaatag

SEQ ID NO: 8276 - DNA, 309 bp, Marinomonas MWYL1
atgccagaaatcattatcacgctcggcgaaggcgatgacgaaaaagacatccgttttgacgtttcaatggaagactacaacgaacttttgaacaaccaagtaccaggggacaaagttggccctggctataactttcttgtgagccacgttcaccaagaagacaaggcaacgtttaaggagcgagtgctggtcaatggcaaaacgcccaacggtatgttggtcatgttgatcgttaatgaaatcactaacgaggtcactggtgatgtggccgtgaagctaaaaaagccgaaagcattgccaagcaaataa

SEQ ID NO: 8277 - DNA, 267 bp, Yersinia pseudotuberculosis YPIII
atggctgaaaaaaacaagattgtattagtagtggggggtgttgaacttatttttgaaccgaatactaccgcctataatggttttattaatgatgtgggcatggaaaataaaattgccccggcatttaaatatctgcgccgtattatcagtaaagaaaccaaagacgcattggatgagattttaaaaatgcccggtgccgcactgcaattgattgataaagtcaataaggtttacgcgcctgagttggaaattgaagtaaaaaactaa

SEQ ID NO: 8278 - DNA, 258 bp, Salmonella enterica serovar Newport SL254
atggaaaaaattaaactgtgtgtctgtgggactgatattatttttgaaccaaatcagaccgcctataataagtttattaatgaaatggcaatggacaataaagtggcacctgcacataactacctgacgcgtattgttgcaacggaaagcaaggaagctttagctgaaatattaaaacgtccgggcgctgcgcttcagcttgtcagtaaggttaatgatatttacgcccctgaactggaaattgaagtaaaaaactga

SEQ ID NO: 8279 - DNA, 258 bp, Salmonella enterica serovar Heidelberg SL476
atggaaaaaattaaactgtgtgtctgtgggactgatattgtttttgaaccaaatcagaccgcctataacaagtttattaatgaaatggcaatggacaataaagtggcgcctgcgcataactacctgatgcgtattgttgcaacggaaagcaaggaagctttagctgaaatattaaaacgtccgggcgctgcgcttcagcttgtcagtaaggttaatgatatttacgcccctgaactggaaattgaagtaaaaaactga

SEQ ID NO: 8280 - DNA, 258 bp, Salmonella enterica serovar Agona SL483
atggaaaaaattaatctggttgtatgtaagaaagaaattacgtttgaaccaaatcagacggcttataataaattcatcaatgaaatggcgatggataataaagtggctccagcccatagttatcttatgcgtattgttgtaccagagtgtaaagaagcgctggaagatattctgaaacgtccgggggcagcgcttcaacttgcagggaaaatcaatgaactttatgcgccagaactggaaattgaagtaaaaaactga

SEQ ID NO: 8281 - DNA, 264 bp, Aliivibrio salmonicida LFI1238
atgacaaccccaatcatcattacagcagcaggcaaagatttacgttttactcctgatttaccaacgtacaacaaatacatcaatgaaatgatgccacatgacaaagtgtcaccagcaaccaattatctgcgtcgtatcgttcataaagacgataaagcacatttagatgaaatgctgaaaattccaagtgctttgatgcgtatcctggcaaaagtaaatgacgcttttgaaggtgatctggaaatcgaagtaaaaaactcttaa

SEQ ID NO: 8282 - DNA, 393 bp, Rhodopseudomonas palustris HaA2; identical to SEQ ID NO: 7874

SEQ ID NO: 8283 - DNA, 381 bp, Novosphingobium aromaticivorans DSM 12444; identical to SEQ ID NO: 7875

SEQ ID NO: 8284 - DNA, 363 bp, Jannaschia CCS1; identical to SEQ ID NO: 7876

SEQ ID NO: 8285 - DNA, 390 bp, Rhodopseudomonas palustris BisB18; identical to SEQ ID NO: 7877

SEQ ID NO: 8286 - DNA, 393 bp, Rhodopseudomonas palustris BisB5; identical to SEQ ID NO: 7878

SEQ ID NO: 8287 - DNA, 375 bp, Rhodobacter sphaeroides 2 4 1; identical to SEQ ID NO: 7880

SEQ ID NO: 8288 - DNA, 351 bp, Paracoccus denitrificans PD1222; identical to SEQ ID NO: 7881

SEQ ID NO: 8289 - DNA, 375 bp, Rhodobacter sphaeroides ATCC 17029; identical to SEQ ID NO: 7882

SEQ ID NO: 8290 - DNA, 393 bp, Rhodopseudomonas palustris TIE 1; identical to SEQ ID NO: 7885

SEQ ID NO: 8291 - DNA, 369 bp, Methylobacterium chloromethanicum CM4; identical to SEQ ID NO: 7886

SEQ ID NO: 8292 - DNA, 357 bp, Frankia CcI3
atgtcgaggatcttctatctcgctttcggggcggcggccggcgtcgtggtggtgcgccaggtggctaaggccgcagcctccctgacaccgacgagtctggccggctctctcgtacagtcggtacaggagttcctcgcggacgtgcgcgaggccgcggccgagcgggaggaggagatccgtgtcgcgctcggcctcgacggtgatccggacgaagcggatcgaggcgacgcggtcggggctgccccgccccgggacaccgcggcgcgggtcgccggctccggcgcgccgcgttaccccgctgacctcgacgacgccgaacgcacgatgcggctcgtccccggcgcccggcggccctga

SEQ ID NO: 8293 - DNA, 231 bp, Arthrobacter FB24
atgaaaagaatcctctggatgggaatcggcgtcgccatcggcgtcatcgctttccgcaagatcaccgaggcccagtccaccttgggccctgaaggcctcaacagggcggtgggccggctggccgacggcatctacgactttgcagacgctgtccgcgatggcatgcaggagcgcgaaagcgacctgcgggctgcactgggcattgacacccaggagctggtgcggcgctaa

SEQ ID NO: 8294 - DNA, 261 bp, Acidothermus cellulolyticus 11B
atgatgaagcgagtcttctatctcgcggtcggcgtcggcgtcggcgtagtcgtcgcccgccgggtgatgcgcgccgctgatcggctcacccccggggggctcgccgaccaggcgcggcggagcggggcgggcgttgccgcggcgatccgcgggttcatcgacgacgtacgcgccgcaatggcggaacgcgaagccgaactccaggaggcgttgacggacgaaggaccggtgagcgaggaccgatggagtccgcggaaatag

SEQ ID NO: 8295 - DNA, 318 bp, Nocardioides JS614
atgaggcgcgggctctggttcgtcgccggggccgggaccgccgcctacgtgctggttcgcggccgccgagcagccgaggcgctcaccgtcgacggcctccaggaccgcctgggcgcgctctcggtcgggatgcggctgttccgcgacgaggtcgcccaggggcgcgcggagaaggaatcggagttgcgcgagcggctcggcctggtgcctcatgggaggcccgagctcgagggcggccggcaccgggccgtcccgtcaccgacacctacccagaccacgaccacgaccaggaccacgacagaggaaggcagcacctga

SEQ ID NO: 8296 - DNA, 306 bp, Salinispora tropica CNB-440
atgaggcggttgttctggctgggcattgggctggccgtaggcgtgctggtggtccgcaaggccacccggacggcccaggcctacacgccggccgggatcgccggcgggctgtccgaatccgctggcggcctggccgagtcggtacgtagcttcgtgtcggacgtccggatcggaatggccgagcgcgagcaggagattcacgaggccttcgcgcgcggcgaggcgttcgacgacaacgtcgccgacctgcgggaacacccgtacaccggcgaccgagagactttcccggaggagcaccagcgatga

SEQ ID NO: 8297 - DNA, 351 bp, Frankia EAN1pec
atggggacgaggatgttctacgtcgccctcggcgcggccaccggggtgctggtggtgcgccaggtcgcccgcgcggtctcctcgctgtcgccgacgggtctggccgggtctttcgtacagtcggtgcgggagttcgccgccgacgtcggcgaggcgatggccgagcgggaggaggagatccgctccgcgctcggcctcgacgacgcggacggctccggcgacggcgagcgtacaggcgccgccacgagcaccggggctgccgcgagcgaccaggacacctctgccccgggtcctgacgagttcgacccggaacggacgatgcgtctggtccccggcgcgcgccggccatga

SEQ ID NO: 8298 - DNA, 306 bp, Salinispora arenicola CNS-205
atgaggcggttgttctggctcggcatcgggctggccgtgggcgtgctggtggtccgcaaggccacccggacggctcaggcctacacgccggccgggatcgccggcgggctgtccgaatccgctggcggcctggtcgaatcggtacgtagcttcgtgtcggacgtccggatcggaatggccgagcgcgagcaggagatccacgaggccttcgcgcgtggcgaggcgtacgacgaccacgtcgccgacctgcgggaggaaccgcacacgggcgaccgagagaatttcccggaggagtaccagcgatga

SEQ ID NO: 8299 - DNA, 231 bp, Arthrobacter chlorophenolicus A6
atgaaacgacttgtctggatgggaatcggcgtggccatcggtgtcatcgccttccgcaaggtcaccgaggcccagtccgctttgggcccggaaggcctcaacagggctgtaggcaggctggccgacggcgtctacgacttcgctgacgccgtacgcgccggaatgcaggagcgcgaaaccgacctgcggagtgcgctcggcgtcgaaaccgcggacctggtccgcagctga

SEQ ID NO: 8300 - DNA, 264 bp, Actinosynnema mirum DSM 43827
atgagcaggctgttctggctcggggtcggggtcgccgcgggcgtcctcgccacccgcaaggccaaccaggccgcccacgccgccacgcccgcgggcatcggcgcgaacgtgggcgagggcctgcgcgagctggccaccgccatcggctccttcggcgccgaggtgcgcgccggcatggtcgagcgcgagcacgagctgcaggagaccgtcgagcggcagacgggtcacacccccggtcggcgagcgcgcagggcgaacgactga

SEQ ID NO: 8301 - DNA, 336 bp, Beutenbergia cavernae DSM 12333
gtgcgccggatcttctggatcggcgtcggcgccgccgctgcggtgctggtcgtgcgacagctcgcccaggcacgcgcgaaggccgacgcagccgccgaggcgttcacccccgccgggttcgccgacctcgtggcacgcggtgtcgacacgctccgcgacgtcggcaccgagattgctgccgcgatgcgggagcacgaggccgagctccgagccgacctgctgcccccacccgacgaggtggccgccgcccgggcccgccgcgcgtccgcaccgcgccccgcgcgcgggagggacgaggacgacggcgcggacgccgagctgtacgagttcttctga

SEQ ID NO: 8302 - DNA, 303 bp, Catenulispora acidiphila DSM 44928
atgttcacaggaactgtgcgccgcctcttctgggtgtccatgggcgcgaccgccggagtgctggtcttccgcaaggtcaccgccaccgccaaggaactgacccccgcgggcctcgcggaccgcgctgccatctccggcggcggtctgctggactcggtcaaggagttcttcgaggacgtgcgcgagcgggcgcacgaccgcgaggaggagctcaacgtggcgctcggcatcgacgtccccccgacgtcgacagaccgtgacccggaaggtgacggtttctccaagaaggcgcgagctatttag

SEQ ID NO: 8303 - DNA, 321 bp, Saccharomonospora viridis DSM 43017
atgaagcgactgttctggctcggcgtcggtgtcgccctcggggtgacgctgtctcgtaaggcgagtgagacggctcgtcaggcgacccccgcggggttagcctcgaatctgggggatgccgtgcgggagttggccggtgcgatcggcgcgttcggcgcggaggtccgtgccggcatgactgagcgggaacaggagctgaacgacatcgtggagcagcgctcgggtctgccgcggtcgggcgtagccaggacagagcggccgcgtggcgggaacgccatgcccgaatcccggagagggcgagcgcgacgggcggagatctga

SEQ ID NO: 8304 - DNA, 357 bp, Jonesia denitrificans DSM 20603
atgaagcgcatcgtttggctcggtattggtgtggcagtgggtgtgtacgcatactccaaggtccggcaagtcgcacgtcagtacaccccggcaggggtatcagaaaaagccgaacacctcgcgagcgatgttgttggccgagtagaaacggctgtcaaaggtctcgcaccagatttctcatcagcatacgcggctcgtgagaaagaactcatggaccaactgctcgctgacacccaagagtccgtggcagagatgcgagctcgacgtgcccggcatgcagcacggccctcgcccgggaatgacacagacatcaccgacgttgaccctgacgaagaggcgctcgggtattctttttga

SEQ ID NO: 8305 - DNA, 423 bp, Nakamurella multipartita DSM 44233
atgaaacgcgtctatgtcttcggcgccggtgtcgccctcggagtggcggcgacccgccgcacccgacgggccaaggaagccgccgccgcagcgatgaaggccaagctcaccccctcggcgatcgccgcggacctggccgacgccatcgccgagctgggcaacgccgtcggcgccttcgcctccgacgtccggcagggggcgatcaaccgccgggccagctaccggcccctggtggacaactccaccggtgcggtggtgatggttccgccggaggcgttgggcccggcccccgagccggtcgagccgcggatccccggcggcctcccgccgacccggcccaccccgacccgcgcccacaccgtcgacccggacccggccggatcgtcccggtccgccgcgcgacgcgtcgggcaccgcgcctga

SEQ ID NO: 8306 - DNA, 459 bp, Ralstonia eutropha JMP134
atgatcactgacgatattgatgttaactgctttccactgcgagtagtgcgtgtccggcgcaacgggaaacgcgattgcgatccggtggccaagcggcgtttgattgagctgtgtcttcggcctggcgcatcggtggcaggcatggcgctcaaggctcaagtcaatgccaatcaactgcgcaaatggattcggctggatcgggaatcgaaggcggtagagcacggttcgctggcggcgttcgtgccggttgttcagggagtccgatctcctgaagtcgaagctgtggtcactgcgccgcgtcgcacgacggctgtggcagttgagccgcaacctcagccgtcgcgaccagtcgcgttgctgagtgcgaagttgccaaacggcgtagcgattgagctcgcatgcggtgagcgtgacggtgaactcgtaaaggcgatgatcgaagcgttgggggcgagctga

SEQ ID NO: 8307 - DNA, 504 bp, Ralstonia eutropha JMP134
ttgcgtccgcaaccactatttgcggacgcaatcatgatggaagccgagtttgacgttccgccgctgagggtgatccgtattcgctccaacggaaagcgagactttgaccggagggacaagcgccaactggtcgaggcgtgtctgcggcctggggtatcagtagccgggatggcgctcaaggtcggcatcaatacaaaccagttgcgcaagtggattcggctgcaccaagtggcaagccaagccactgcggccgcggaatctgcgttgccggagttcgtgccggtcgtcgaggttagcggcgtaacgcgcgtcacggaatcgccgatggtgcagggatgtctgccggcccaggcaccagctcgcactcaaccatcgcagcgtccgtctttggtgcctgcgcgactgacggcgcggctgcccaatggcgtgaccatcgaacttgaatgtggtgggcaggacgttgcgcttgtgaaggcgatgatcgaagcgttgggagagcgttga

SEQ ID NO: 8308 - DNA, 495 bp, Burkholderia xenovorans LB400
ttgcggacgcagatgatgaccgacactgactttgactttctccctctgcgcgtaacccggacgtgcgcggatggcaagcatcgatacgatccggagggcaagcgtaagttgatcgcagcctgtcgccggccgggcgcgtcattggctggtctggcgctgaaggctggggtcaatgcgaaccagttgcgcaaatgggtgcaactggaagagcgacgtgaagttgccgacgtttcacatgatgctatcgcgcaagcaccgtcaaccttcgtgccggtcgtcttgatcggcgagtcactggcatcgactcctgcggacacagcattaccagccccgcggccgttgctgcaacgagatccgccacgtccgtcgccgcgagctgcaccacttgcgcgcttgtcggcaacactgcctaacggtgtcgtgctcgagctcgaatgctctgggagagacacctcgctggtcacggcgatgattgccgcgctgggagcgggctga

SEQ ID NO: 8309 - DNA, 468 bp, Burkholderia xenovorans LB400
atgacccaggatgacctttcatttttgcccctgcgggtgacccgcgttggcgtgggtggcaagcgcagcttcgatcctctaggcaagcggcggctggtcgaggcctgcgagcagcccggtgcgtcattgtccggtctggcgttgaaggccggggtgaacgccaatcaactgcgtaaatgggttcggctgcatcggcaggcgcaaacgcgcatgagcaacgacggcatggccgcttcaccgtcggcgttcgtgccggtcgtcgccatcgccgatacggcgccggcgcctgcgtcgatgcattctgtgcgcatgcagccagaacagcggtcatcgcatctgtcttcgcgctcaccagcgtcagcatggctgtcggcccagttgcccaatggcgtaaagcttgagctcgaatgctcggaacgcgacgccgcgctcgtgagcgccatgatcgcggcactgggacggcgctga

SEQ ID NO: 8310 - DNA, 504 bp, Polaromonas JS666
atgacaacacctgcaggcaccccctccgaatccgccgtcacgccagcagcaccgatgctggtgctggaccgcaagagcaacggccgcgccatctacgaccccgaagccaaacgagccttggtgcagcagtgcctgcagcccggcgtatcggtggcggccacagccctgcgcgccggcgtgaacgccaatctgttgcgcaagtggatcaccaaacaccagcgcggcatcggcgagcgagcatctgcgccgcccagcaccatcgctggcgaccggatgcccgtcgtgctgcgctgcgatactgctgccgcgatgaccgccgcaccagcgcctggcagcttggcgggcgcgccggctcccatcactatcgaactgcacggtgcgcgcgtgcacgttgccagcggcgtcgatcctacaacgctcgcagccgggtgcgggcgttgcgcaccaccgcatgatcgcgcccccatcgggcacgcgggtgtggctggccgccggcatcactga

SEQ ID NO: 8311 - DNA, 513 bp, Nitrobacter hamburgensis X14
atgcatgaggtgtccaccaaaataggtggacaccttgtgatggaagacgatgatcagaaactgcgggtaaggcttgttggtcggaacgggcgacgccgttacgaccccgcatcgaaggaccgtcttgtcgcggcctgccttgagcctggcgtgtcggtatcgaggcttgcgctcgaacatggggtcaatgcgaaccttcttcggaagtggataaagaaacgcacggagacccagtccctcccgccgtcctcatcaccggcgtttatcccggttcagattgaaagcacgtccgatcgggccttgctgcgacagagcagcatggctgcgatggatttgccgggagcttgcgatggagtgcgtgggtcggcatcgaaaagggctgcgccgttttcctctccagcgaaggtgagcgcgtcactgccgaacggcgtgaagttgacgctggagtgcggtgatgtggatgcattgacggcgatcatcggagcgctgggtcatgttcagactgggcgctga

SEQ ID NO: 8312 - DNA, 480 bp, Burkholderia cenocepacia HI2424
atgacagaacaacattcagaaacgtcgggcctgaaggtcgtcagcgttggcatagacggtaagcgtcgattcgatcggcataccaaacgccgactcgtcgaggcttgcctggagccgggagcatcagtcgcaggactcgcactgcagcacggcgttaatgcgaatctcctgcgcaaatggatcaagctgcatcagcaacggctctctgaggattcgacgcagtcgtcgaccgcagagtcggcattcgtgccggtcgttatggttagcagtgaacaggcgctcgtcgagcacaattccgtcaggtcttcatcgttggccgcgaccgctagttcgccagcaaatgcagcggccgcgtcgacgctgacggcgcagatgcccaacggcatcacgcttaagctcgaatgcggcaagaacgacgcagcgcttctatcagtgatgatcgaaacactgggacggtgtgatgttccggctaagcgatga

SEQ ID NO: 8313 - DNA, 468 bp, Sinorhizobium medicae WSM419
atgatggaagaaggtcaaaaacttgtcgtgcggctcgttggtcggaatggacgacgccggttcgatccggcatcgaaagaccgtcttatttcggcctgccttgaacctggcgcatcagtatcgaaacttgcgctcgaacatggggtcaacgcgaacctcgtttggaaatggataaagaaggccaaggaggtccgtgctctgccgccgtcttcgacatcggcttttcttccggttcagatcaccgcggcgagcagcctgccaatgcacagcagcgcgtttgcgttggagatgcctgccacggatggtgaagagcgacgatcgcaatcggagaggatcgaccggctgtcctctccagccaaggtgagcgcgtcactgccgaacggcgtgaagctttcgctggaatgcagggatgtggatgcgttgacggctgtcattggagcattgggccatgttcagactgggcgctga

SEQ ID NO: 8314 - DNA, 459 bp, Xanthobacter autotrophicus Py2
gtgaggtgctcaacctttcggtcctctgatctggcagcagtgccagcagcggtgctggagaagacggtggacgcaggggagacctatgtacgacggcggcgttggagctgggccgagaagcgggcggtcgtcgaagaggctgcggccagcggcaacgtcatcgggacggcgaagcgccatggcatccaggctcagcagatttaccgttggcgtgaacgctttgctgaacggcttgatcctcccgggttcgcagccgtgtcggtcgtcggtgatccaccgaaggcgcttccagcaccgatgccggatatggatcgtccggaagagcgatccagcaccgtccagaccgatgcccggatcgagatcgtctccgccggaggtgtggcggttcggctgccggccggttcgccgacggatttcgtggtcgcgattgccagcgccctgtcccgaggccgacgatga

SEQ ID NO: 8315 - DNA, 465 bp, Burkholderia phymatum STM815
atgactgacgatgatttgacctttttgcccttgcgggtgacacgcgttggtgtcggcggcaagcgcagcttcgacccaatgggcaagcaacgactggtcgatgcgtgcctgcaaccgggcgcatcgctgtctgggctggccttgaaggccggggtgaatgccaaccagttgcgcaaatgggttcagttgcgcgaacagtcaaatgccccggtgaatgaaggcatggccgtcgcctcatcagctttcgtaccggtagttacgatcggtgaaccggcgccgtcgattgctctgccacccgctcgccgcccctttccagagccggaaccctcgcatcagtcgccccgagcggcaccggtggcaagactgtcggccacgttgcccaacggcgtgaagctggaactcgagtgttcggggcacgatgcgacactcgtgactgcgatgtttgccgcattgggggcacgctga

SEQ ID NO: 8316 - DNA, 480 bp, Burkholderia phytofirmans PsJN
atgacagaagaacactcagaaacgactgggctgaaggtcgtcaacgtcggtcgggacggcaagcgcagatatgaccggcaaaccaaacagaagttggtggaagcgtgtcttgagccgggtgcttcggtcgccgggctcgcactcaagcatggggtcaacgccaacttgctgcgcaagtggatcaagctgcatcagcagcgattgcctcgcacgtccctgcagccagcgccgactggcacagctttcattcctgtagccgaagtcgatagtcacgaagcggtggtcgcgcccgcatccgcgaaggcacaccgccacacccccgcagcaaggacatcgtcgcccgcgatgacgtcggtgcggctgatggtgcagatgcccaacggcgtcacactccggtttgaatgcagcggcaatgacgcgccgttgctatcggccatgatcgagacgctgggacggtgcgatgttccgcctggacgatga

SEQ ID NO: 8317 - protein, 199 aa, Acidithiobacillus ferrooxidans ATCC 53993
MADSIMCIETLHNCLVRVHMKRLDLLNRLSALEQKGLVVYSRRDLEKIFPEEDEKALEKSLQRMCQDNLLVRAARGIYVFGPAVPRHRGWLIERIAQALRPGDFNYVSLESILSEYGVISQIPVDRLTVMTTGAKGLHKTPFGAIEFTHTKRTIPDLLERTLVVKGRPLRIARKQAAIQDLHRVGRNIDLIDRDEVDDE

SEQ ID NO: 8318 - protein, 209 aa, Ammonifex degensii KC4
MRMTEWYRLFQENSFKKVFTFDDLHVLTGLPTRELKVELSRLVKRGLAERLAKGVYANPFNYPSPAEIAMVLRPPCYISMEHCLSEEGILSQHSFTVTCVTLGTPGTVRTSRTIFEYHRIARRLFWGWREDGQGVRWAWPEKALLDLIYIRHLRTRELSRERLLSLLDDMYLGELNGERLVEFLSRFGSPHAEKIADILTEAGLTISPS

SEQ ID NO: 8319 - protein, 183 aa, Bifidobacterium longum DJO10A
MKRSEAIDQLREMDAKYSCYVYCKNELAVVLGEQGQKLNRTLSSLVSAKALVRAARGVYVFAYSSHLGEGTLHQVAKRLRSGELVWESLESALSRWNVISQIPVDRVTFMTTGREGEFHTPYGVIEFTHCKLSWDRILPNLIARDDGLTPLASKQWAYRDLKAVGRNLDLVDMDELEDDDDWN

SEQ ID NO: 8320 - protein, 183 aa, Bifidobacterium longum longum ATCC 55813
MKRSEAIDQLREMDAKYSCYVYCKNELAVVLGEQGQKLNRTLSSLVSAKALVRAARGVYVFAYSSHLGEGTLHQVAKRLRSGELVWESLESALSRWNVISQIPVDRVTFMTTGREGEFRTAYGVIEFTHCKLSWSRILPNLIARDDGLTPLASKQWAYRDLKAVGRNLDLVDMDELEDDDDWS

SEQ ID NO: 8321 - protein, 183 aa, Bifidobacterium longum longum F8; identical to SEQ ID NO: 8320

SEQ ID NO: 8322 - protein, 199 aa, Bifidobacterium longum
MYMNMRFYIYSCTLICMKRSEAIDQLREMDAKYSCYVYCKNELAVVLGEQGQKLNRTLSSLVSAKALVRAARGVYVFAYSSHLGEGTLHQVAKRLRSGELVWESLESALSRWNVISQIPVDRVTFMTTGREGEFRTAYGVIEFTHCKLSWSRILPNLIARDDGLTPLASKQWAYRDLKAVGRNLDLVDMDELEDDDDWS

SEQ ID NO: 8323 - protein, 183 aa, Bifidobacterium sp. 12 1 47BFAA; identical to SEQ ID NO: 8320

SEQ ID NO: 8324 - protein, 179 aa, Cellvibrio japonicus Ueda107
MHQTTAIQRLAACDKTGRYVFTYRDLAKIFPEDSVRTLQAGLKRLVQQGILINPAKGIYLYSLSRHKDSNTLEQIAKTIRRGEYNYVSLESALSEYGAISQIPIDRLTVMTTGRKGEYKTSFGTIEFTHTKRPVSDIVSNRIDVGRPLKLASKAAAYRDLKRVGRNTHLVEEQVIYEDH

SEQ ID NO: 8325 - protein, 192 aa, delta proteobacterium sp. MLMS-1
MTPTPHRQPGRRLAAVLEEVADSEHYLFTLADLRGALPEIGAGAFKTLLSRAEKRGLLQRVCRGLYLYPRVDYPRDLLLFHAAARLRADAFNYISLETALSDAGVISQIPLNWITLMSSGRRNIVRCGRFGTIEFIHTRQQPAALAAELTYDPRCRLWRASVSLALRDMRATRRNLDLIDEELAREFAHESD

SEQ ID NO: 8326 - protein, 192 aa, delta proteobacterium sp. MLMS-1; identical to SEQ ID NO: 8325

SEQ ID NO: 8327 - protein, 178 aa, delta proteobacterium sp. MLMS-1
MDRKTAIKVLAEWDEAGRYVFTLRDLVKLFPGDNPKTLQAAVNRLVGDGFLQRASRGVYVYPLARSKDSHTIERIAVALRRGEYNYLSLESALSEYGAISQIPVDRLTVMTTGRKGVYRTPWGTIEFTHTKRPIPDILDSAHDVGRPLRLATPMAAWRDLKRVGRNTHLVDQGALTDD

SEQ ID NO: 8328 - protein, 178 aa, delta proteobacterium sp. MLMS-1
  misc_feature (17)..(17): Xaa can be any naturally occurring amino acid
MDRKTAIKVLAEWDEAXRYVFTLRDLVKLFPGDNPKTLQAAVNRLVGDGFLQRASRGVYVYPLARSKDSHTIERIAVALRRGEYNYLSLESALSEYGAISQIPVDRLTVMTTGRKGVYRTPWGTIEFTHTKRPIPDILDSAHDVGRPLRLATPMAAWRDLKRVGRNTHLVDQGALTDD

SEQ ID NO: 8329 - protein, 188 aa, Desulfurivibrio alkaliphilus AHT2 uid49487
MMPTPHPQPGRRLAAVLEELASPEHYLFTSADLRGALPEISAGAFKTLLSRAEKRGLLRRICRGLYLYPRVDYPRDLLLFHAAARLRADAFNYISLETALSDAGVISQIPLNWITLMSSGRRNIVRCGHFGTIEFVHTSRQPATLANELTYDPRCRLWRASVALALRDMRATRRNLDLIDEELTRESA

SEQ ID NO: 8330 - protein, 179 aa, Eggerthella lenta DSM 2243
MKSVEAIKILHGCDLEGRILFRSRELGALFDEHGDTLRSTIKRLTADGILERVAHDAYLYLLSHPNGCDLLGHIAAFLRPGGATYESLESAASQWGFISQIPLGRISCVTTGAEGLVDTRFGAIEFVHTDDDLDAVKRGIIDRMPRNRLPIATEERCLHDLVSRKRSLELIDWDEVDVD

SEQ ID NO: 8331 - protein, 174 aa, Helicobacter canadensis MIT 98-5491, ATCC 700968
MTSIQLLKVLDEIDKNLRISVLSAKQLRLFFPNESKSVFSVGLNRQVKNGLLVKLCNGLYFNKRSRHIPPNFLEYVATKIRAKETFYLSLESVLSENGLISQIPNRLTFISSSRSQIFHTPYGIIEFVKTSKKEFFDEKNGIVYNENRGIFEASVERAIKDAYKHRRSIDLLEE

SEQ ID NO: 8332 - protein, 178 aa, Marinobacter sp. ELB17
MQPIQQLEQWLLRTKSGINAYLYSAAAFRSLFPDLSAGAYRSLLRRAEKRGLLERVCKGIYQYAGNPDSSGSILFHAAALLRARNFNYISLETALSEAGLISQVPIAWITIVSTARSATINCGRFGTIEFLHTERAMSEIAGELNYDVSRHLFLASPTLALADMQRFNRPTINLVTEV

SEQ ID NO: 8333 - protein, 174 aa, Marinomonas MWYL1
MRKKEKLLSALSHATKAGGGVHTATEIAFMLGEKHTPAFTKFLTDCVRKGVLRRVAAGIFESTITPPDGSTAIYKVVNKLRGDVLNYISLESQLSYTGDISQIVMDRLTVMTKGRSGIFSTPYGVIEFTHTKKTIEAIAPNIYFDSDIKMYRAKTIQALIDLKNCNRNLHMLEA

SEQ ID NO: 8334 - protein, 181 aa, Pantoea sp. At-9b
MDRMTAIERFNAFDKKGRYVFTTRDLAKIFHEDSPKTLNAGLNRLVKDGILSRAIRGVYVYAHARSKDAYTLERIVLALRRGEYNYLSLESALSAYGVISQIPIGRITVMTTGRSEEHKTPFGVIEFTHTKRSPEQILRDTYMGDSPLRQATMAAAARDLRRVGRNTHLIDESELNRESES

SEQ ID NO: 8335 - protein, 187 aa, Parascardovia denticolens DSM 10105
MLGGMRLPGCLKVLAEWDGRFDRYVYAKRDVAKLLGESGDVLSATLSRLVKAGVLVRAAHGVYVYAYSRHVAEANTVHLIARSLRRGCVTYESLESALFSYGVISQVPVGHTMYMTTGRSGAYDTPYGSIEFTHTKRGVGDILPGLKYPQGCALPLASRRMAVDDLRHVGRNLDLVREMEDADEPES

SEQ ID NO: 8336 - protein, 181 aa, Pectobacterium wasabiae WPP163
MDRITAIERLNAFDKQGRYVFTSRDLAKIFHEDTPRAFNAGLNRLVKDGILTRAIRGVYVYNHAKSKDAYTLERIVLALRRGEYNYLSLESALSEYGVISQIPIDRITVMTTGRSEEHKTPFGVIEFTHTKRPPEQILQDTYFGNSPLRQATKKTALRDLRRVGRNTHLIDESELHHESES

SEQ ID NO: 8337 - protein, 206 aa, Photorhabdus luminescens
MVFLYTNNCYDEYLHTKHPLKGFYSRDNTMDMLTAINKLDEFSKMGRAVFLLQDLEVIFADETSRTLQKSIDRLIKAGLLLRITKGVYVYTRASIGSYPLETIAKNIRRGEYNYISLESALSQYGFISQIPIDRLTIMSTGRAGEFKTPWGVIEITHTSREPSEILKATLESRGPLRIAKKETALRDQKRVGRNMHLVQLEELNYV

SEQ ID NO: 8338 - protein, 189 aa, Photorhabdus luminescens
MNIKTTNTYPMDRSTALKRFIDWDKKGRYVFTLADLRKIFPEDSPKTRQAGLNRLVKESMLSRPVRGVYLFNFAHNRDSYAIEHIAKALRRGEYNYVSLESALSEYGVISQILIDRLTVMTTGRKGLYHTPLGTIEFTHTKRQQEDILASITQANRPLRLAKLECALRDLKRVGRNTHLVNKQEITHGQ

SEQ ID NO: 8339 - protein, 177 aa, Proteus mirabilis ATCC 29906
MELIRAINVFNKFSKQGRNIFLTKDLKMLFPDESPKTLQKSVDRLIAHDVLRRASKGVYIYTQGSLGPYPLERLAENIRRGHYNYISLESALSQYGVISQIPIDRLTIMSTGRSGEFVTPWGVIEVTHTAKKPLEILNTTVEGRGPLRIATKETAIKDLMKVGRNTHLIQREELNYV

SEQ ID NO: 8340 - protein, 177 aa, Proteus mirabilis; identical to SEQ ID NO: 8339

SEQ ID NO: 8341 - protein, 178 aa, Proteus mirabilis
MKKIEAIKKLLEYDKRGRCVFTNSDLANIFHQDNERALRAGIKRLQDDGLLTRIINGVYLYNLAQSKGSDTLEQIAKTIRRGEYNYISLESALSDFGVISQIPVDRLTVMTTGRSGEFKTPLGTIEFTHTKRAPIDIIENTTLVGRPLRLATKQTAYRDLKRVGRNTHLVSKEELYEN

SEQ ID NO: 8342 - protein, 174 aa, Shewanella denitrificans OS217
MAKSDELLNVLAKAVKAGGGIHSATELAFMLGVPCDPAFRKFLTDCVKKRRLRRVIKGFYESVITPPEPETAIYKIIKKLRSGVLNYISLESQLSHTGDISQIVMGRVTVVTKGRSGCFDTPYGVIEFTHTKKPIEQVAPNLYYDPDIKMYRAYKEQAIADLKHCQRNLHMLES

SEQ ID NO: 8343 - protein, 184 aa, Verminephrobacter eiseniae EF01-2
MKKIDLIHRLAALDKRGVYILSKADIGKMFPGEGAKAMEKSLQRMVADRLLIRAARGIYVNPAAASRNSRIIEDLAKALRPGALSYLSLEAILSEYGVISQIPMDRITVMTTGASGTHETPFGTIEFTHTKRSVADILAHTQRIEGRPLRIAHKMAAVRDLLRVGRNVNMIDREALEEDAVEVA

SEQ ID NO: 8344 - protein, 177 aa, Xenorhabdus nematophila ATCC 19061 uid49133
MDKITAIKTLDKFSKMGKNIFLLQDLEIIFADEAPRTLKKSIDRLIKAGLLVRITKGIYANALASLGSYPLESIAINIRRGEYSYISLESALSQYGIISQIPIDRLTIMSTGRSGEFETPWGVIEITHTNKKPSEILKGTLESRGPMRIARKEIALRDLRRVGRNTHLIQREELEYA

SEQ ID NO: 8345 - protein, 177 aa, Bifidobacterium longum longum CCUG 52486
MNRLRDMDTGFGVHVYRKPDLALVLGETGQRLDRTLSSLVAANVLVRAARGVYAFAWSAHLGEATLHTVARRLRPRQLVWESLESALSRWGVISQIPVDRVTFMTTGREGLAVTPYGTIEFTHCALDWSRILPNLVPRDGGMTPLASKRWAYRDLKATGRNLDLVDMDELENDDGWE

SEQ ID NO: 8346 - protein, 183 aa, Bifidobacterium longum longum CCUG 52486; identical to SEQ ID NO: 8320

SEQ ID NO: 8347 - protein, 174 aa, Helicobacter canadensis MIT 98-5491, ATCC 700968
MAKIDKLLSALASAVKAGGGIHSAAELAFMLGEPCNPTFRKFLTDSVKKGQLRRVVKGLYESVLTPPEPETAIYKIIKKLRSNVLNYISLESQLSYTGNISQVIMGRVTVITKGRSGRFDTPYGVIEFIHTKKPIEQIAPNLYYDSDIKMYRANTAQAIIDLKHCQRNIHMLDL

SEQ ID NO: 8348 - protein, 69 aa, Providencia rustigianii DSM 4541
RLTFISSSRSQIFHTPYGIIEFVKTSKKEFFDEKNGIVYNENRGIFEASVERAIKDAYKHRRSIDLLEE

SEQ ID NO: 8349 - protein, 247 aa, Acidovorax delafieldii 2AN
MVAPVRNAMEEATAAMRRTGELRGHSPPRSIENRITCTKVMRILNSPLMNQSDHILELARHRRVLRAADVREHGWSPQLLIRLHQAGKLQRFARGLYGLPDAEVTEHQTLIEVCQRVPKAVLCLLSALQFHEIGTQLPHEVWIALPEATQTPALSYPTLRITRLRGAAYNEGIQTVTDHGAPIRVYSAAKTVTDCFKFRNKIGLDVALEALKDAWRSRKVTMPELSHFAKTNRVERVMQPYLEAVTQ

SEQ ID NO: 8350 - protein, 207 aa, Acidovorax sp. JS42
MRILNYPLMNQSDHILELARHRRVLRAADVREHGWSPQLLIRLHQAGKLQRLGRGLYGLPDAEVTEHQTLIEVCQRVPKAVLCLLSALQFHEIGTQLPHEVWIALPEATQTPALSYPTLRITRLRGTAYSNGIQTVTEHGAPIRVYSAAKTVADCFKFRNKIGLDVALEALKDAWRSRKVTIAELSHFAKINRVDRVMQPYLEAVTQ

SEQ ID NO: 8351 - protein, 186 aa, Agreia sp. PHSC20C1
MRAFSQSEASRAGVDSRQLYRLLERQQIERISRGLYRRADLSIVDLDLIEIAARRPDATICLESALARHELIDAIPTRTDIAIPRGKKPAKTQAAVDWHLFDRATFHIGRTLLETGDAGQSIGLYSPERSIVDAFRLRGTAGYETGIEALRNWLKRPASQPAKLFEIAQSLPRAIGPLRTALEILT

SEQ ID NO: 8352 - protein, 206 aa, Asticcacaulis excentricus CB 48
MEPPALTQQQRLNAIVKARPLVRAHELRAQGITAATISRAEASGLIRRVSRGLYQSLDSDIDTNQPLAEISKQIPNGIICMTSALAYHGLTDQMPRRIWVAIAKDTWAPTVSYPPMRLVRFKAASIRDGIEYHLISGVEVPIYSVARTLADVFRNPRLVDRSVAIESLKSALSQRKATPSEIYEAARHGGTSKTIAPYLEALTSNG

SEQ ID NO: 8353 - protein, 223 aa, Bradyrhizobium japonicum
MIKHLLYLSRSEETSHSMPSTSAQRLRALDLLKTRGMLRLKDFIAEGIGPETLARLVREEAVVRPARGLYQLPDAHLEAAHTLAEAAVLVPKGVVCLTSALQYHELTLQMPSAVWMAIDRSAWRPKIDYPPIRFVRFTGSALTEGIERHRIENVDVPITDPARTIVDCFRYRTKIGLDVAMEGLREGLRRRRCKPDQLWHYARKARVWSVMRPYVEAMVSDGA

SEQ ID NO: 8354 - protein, 195 aa, Brevibacterium mcbrellneri ATCC 49030
MIDVTTINLTPVFTLEQARAAGLRKDEIYDLLAAEEIERVGRGVYLYPGMLDERFVSLAAATALRSEATMCLTSALANHDLTDVIPFDTDIALPRGTRHPAGFDHVTWHSFATDTFTLGRETHRVAPGVTLAIYSPERTIIDCFRLMHHLGGEIAYEALRRWLRRTGSTPGRLLRMADAFPKAKPRLRLALEVLL

SEQ ID NO: 8355 - protein, 202 aa, Candidatus Accumulibacter phosphatis clade IIA UW 1
MPDMDTTAERLIELARSRGLIRPCDLAPFGIPRVSLTRAVRSGLLERIGRGLYGLPGREVSAHGLLAEVARRVPKGVVCLLSALRFHGLTTQAPFEVWLAIENKALAPKLDYPPLRIVRFSGKAFTEGVEEHVVDSVTIRITGVAKTVADCFKYRNKIGLDVALEALREAWHERRMSSDDIWRYAKVCRVANVMRPYLDSLT

SEQ ID NO: 8356 - protein, 197 aa, Parachlamydia sp UWE25
MRNSKYAEQLKSFQYIPFFTVEQAADRNVPRHAIAYLVKKGILERIYPGTYRFTEYEPKVDFQWENLGLIAASIPKGVICLISALCYYELTDQVMREIWIAIPHESYAPKRPNTKVIRMRNTNLGKTEIVLGEYKVKIFDQERCIIDAFRYLSKEIAIKALQRYLKNTANKADLKKLGAYAKKLRVDITPYILSCTT

SEQ ID NO: 8357 - protein, 203 aa, Chlorobium limicola DSM 245
MSQQRTAADRAKALILARGGLIRTREAISLGIHPRTLYSLRDSGELEELSRGFYQLKREKQLEYPDLVTVSLRVPNGVLCLVSALSFHEMTTQVPHSVSLALEKGAEQPRIEHPPVTVYRFSPSCFKLGIETHQLDGVPVNIYSPEKTLVDCFKFRNRIGMDIVLEALKLYRQRLHKNLHALMQYAEVCRVASVMKPYLEATL

SEQ ID NO: 8358 - protein, 204 aa, Chlorobium phaeobacteroides DSM 266
MLQQSTVAADKAKALILARGGLIRTREAISLGIHPRTLYSLRDSGELEELSRGIYQLRGCKQLEYPDLVTVALRVPNGVLCLVSALSFHEMTTQVPHSVSLALEKGAEQPRIEYPPVTVFRFSSSCFKIGIETHQLDGVSVKIYSPEKTLVDCFKFRNRIGMDIVLEALKLYRQRMQKNLHALMQYAEVCRVASVMKPYLEATL

SEQ ID NO: 8359 - protein, 199 aa, Prosthecochloris vibrioformis DSM 265
MKTTKDKILDVAGKQSVFRAGDIPGVRKPQTQLCRMVADGELIRVGRGLYSLPDAEVGENHSLVEAVKLCHGGVICLISALYFHRIGTRLPYETWIMRQNRNVAPLKGSPVRFVYCTGEAFSFGVEKHMIEGTEVSIYSPAKTVADCFKYRNKIGLDVALEALREGWMAKLFTMNELYAAVKVCRVQKIIQPYMEMLVQ

SEQ ID NO: 8360 - protein, 204 aa, Conexibacter woesei DSM 14684 uid43467
MRVPSHSNLEFLRERFDGRPFRVSDAVAAGVSRTTLHRLRATGELATVGRGVVQLPDGGMGLLSELAVVSARAPRGTICLNSALAFWDLSDEIPEQVHVAVPRGMHRPSIDQPATRVHVFDARTFAIERQQAHTDADEPFWIYSPERSVIDAMRMARWVGRDTALHALRRYIAQPRSDAARLAELARELGGSAQLRPALEALLS

SEQ ID NO: 8361 - protein, 324 aa, Corynebacterium glutamicum R
MRIEEIATLASDQNGLFTTAQAARLEVDRVTLHRAARNGVVRSIRHGVYIFESAPFSPDEELRAAWLSLDPSRTVAERLQTPEQIVICTTSAAQQYGIGDFDTPQHEFYSAQRKQTRADDIRLRIRTLDNEDIEIRDGLPLTTPTRIILDLLEERHDLVHISRLIADAARKGLKVEWSRLATHAHKFAGDYQLTDDGLLQALAESSESTSDTAMAALSMLESSSHLNDLFNKDLANLVGGFSKHLTIQMPEIPDLAAQLSRVQLPDIADQIPDLGFLPNVHSQIHDYLHHDNAVNFTKDSHTSTNKKEMRNTSNEQEKPRTTQL

SEQ ID NO: 8362 - protein, 204 aa, Delftia acidovorans SPH-1
MPAPGSALEQAVLALAEQRPLLRARDLAALGLPTMALSRLVAAGRLERVARGLYSLPGRPLSEHRSLAEVALRVPQGVVCLLSALRVHGIGTQAPFEVWMAIPHHSPTPRIDQPALRAIRMSGAALSEGVETLQIDGVGVAVFNASKTVADCFKYRNKIGLDVALEALRDGWAQGKLTADALWHYAAIDRVSNVMRPYLESIAA

SEQ ID NO: 8363 - protein, 197 aa, Candidatus Desulfococcus oleovorans Hxd3
MKESPITIFRKHGGQLRMSEALSHGVTRYMLYSLRDKGIIEQVTRGVYRLTELPPLSNPDLVTVSLRFPNAVICLISALYYHNITTQIPHFVSVAVPRNSRIPSLDYPPVQAHRFNDEAYRSGIENRTIDGASVKIYAPEKTLADCFKFRNKIGMDVVLEALKLYRTRQQFNLEKLLMYAEVCRVKKIMAPYLEAML

SEQ ID NO: 8364 - protein, 197 aa, Desulfomicrobium baculatum DSM 4028
MKQTPEDVFRANGGQLRMSEAIAHGISRYMLYSLRDRGVIEQLSRGVYRLVELPPIGNPDLVTVALRVPNAVICLISALAFHEMTTQIPHGVSVAIPLQARRPELDHPPLFVHRFSGASYTAGVEEQRIDGVPVNIYSPEKTIADCFKFRNKIGMDVVLEALKLYKTRKPFKLAALLDYAKICRVQNVMRPYLEATL

SEQ ID NO: 8365 - protein, 208 aa, Eggerthella lenta DSM 2243
MNKNRHTSAIEELSASEGVFTTAQAERLGIPRNAIAKACEAGRLVRVAHGAYRMAGVPASQLDDLAALWKLTDPAKMTHERMQAGEWDGVTVAGSTAASILGIGDFYLSPYRILAPRRINSRNAEARFGIRGVPRDDVSFIEGIPVTGAERTLVDLVLDGEEPSLVQDAFADARAKGLDTEKLERLAAEAKASARERKTMERLFGGEA

SEQ ID NO: 8366 - protein, 208 aa, Eggerthella sp. 1 3 56FAA; identical to SEQ ID NO: 8365

SEQ ID NO: 8367 - protein, 108 aa, Sinorhizobium medicae WSM419
MALDRAAWRPKFDYPPIRFVRFTGAALTEGVEHHRIENIDVPITDPAREIVDCFRYRTKIGLDVAMEGLREGLRRRRCKPDQLWHYAHKARVWSVMRPYVEAMVSDAA

SEQ ID NO: 8368 - protein, 205 aa, Sinorhizobium medicae WSM419
MSGSVTQRQIARTVLIERGIARLAELRNAGVTAATMSRMERDGEVLRLARGLYQLPDAELDTNHSLAETAKRVPKAVVCLVSALAFHGLTDQLPRHVWLAIGRKDWAPKLDGTPIRIVRFTDSLLNDGVEIHVVEGVPVKVFGVAKTIADCFRHRSKIGLSVAIEGLQEALRQRKATPSDIVNQAERGGVGTVIRPYLEALTVNG

SEQ ID NO: 8369 - protein, 108 aa, Sinorhizobium medicae WSM419; identical to SEQ ID NO: 8367

SEQ ID NO: 8370 - protein, 204 aa, Gemmata obscuriglobus UQM 2246
MPRSARQSAQTLAALAHEQGGYFTTKQAKEAGYGYNHLDYHETAGNFERVDHGLYRIPAVPRDEHDELIRLSLWSRNQKDEPQAVVSHDSALVLHEMTDLLPDRIHLTVPRTFRKPTPTGCVLHKAVIAEGDVEERTGFRVTSPFRTLLDSAQSEVSQEELEKAVANALTRGLVRRTKLSQAVEQNPRLSRLKAALGRIKANTK

SEQ ID NO: 8371 - protein, 202 aa, Gloeobacter violaceus
MATDSVSASRECLQNRAIFRFKDLNGSGLHRSSLRRLEEAGQIEQIARGIYRNTRADITTHHSLAVASTLVHRGIVCLLSALRFHELTTQAPFEVWMAIDHKAYRPADLAIPLRVVWFSGEAFTSGVEEYVVEGVPVRVYCLAKTVTDCFKYRNKIGLDVALEALRECRREGRCSMDELWHYARICRVANVMRPYLEALAET

SEQ ID NO: 8372 - protein, 224 aa, Gordonia bronchialis DSM 43247
MRTGDGGWSAVRELADRQFGLFTTAQARERGVAAYELARMAHRDLIMRVHHGVYEVPESDAWMTFGDWAAQWLALHPAADIESRRADPDCVISHAAAAQMLRLGTITASGLELSGPHRINVRDHTVRTWRRPIGERGRDWDLVDGLPVTTPRRTITDLLMSYGDGGHLGTALHTCLTEELLDVAELTALCERAAPRWDHTSGEDLVSSLLQQAQMPTTAGATAR

SEQ ID NO: 8373 - protein, 199 aa, Gordonibacter pamelaeae 7-10-1-bT, DSM 19378
MNELSASEGVFTTAQAMRLGIPRNVLAKAREAGKLVRIAHGAYRMAGTPASQLDELTAAWKLTDPAKMTHERVPVDAWDGIAVAGNTAASILGIGDFYLSPYRILAPRRINSRNVETRFGVRDISRNEVSFASGIPVTSIERTLVDLVLDGEDPSLVEDALSDAREKGLDEERLIRLAADAGASAQAKRKMARIFGEEA

SEQ ID NO: 8374 - protein, 185 aa, Intrasporangium calvum 7KIP, DSM 43043
MPAATLLRAGERATSRSTFYRRANAGAYERIARGLYLPSDADAADWDWLEAAAKHPKATICLTSALAYYDLTDDIPQALDIAIPRGSRTPATEGAIAWHHFAADSFGLGRTTIAIPGSNMHIGIYSPERSIADAFRLRGSLGYELGRDALRRWLGQGGKPADLLEIASKLPRTRGPLLRTLEVMA

SEQ ID NO: 8375 - protein, 198 aa, Legionella longbeachae NSW150 uid46099
MTNKNPEEIFRQYGGQLRMSEAIKHGITRYMLYSLKDKGIIEQISRGVYRLTSLPPLSNQDLVTVSLRIPNAVICLISALSYHGLTTQIPHSVSIAIPRETHTPSLVYPPIQVHRFSGQAYLAGIEEHLIDEVNIKIYSTEKTIADCFKYRNKIGMDIVLEAIKFYRARKQFNMNEILKYARICRVDKGITPYLEAII

SEQ ID NO: 8376 - protein, 202 aa, Legionella longbeachae NSW150 uid46099
MKKEDNYKQKVLQMASKTGVIRMSDLTKKGITRATFSRLVREKKLEKLAPGLYCLPQAELSEKESLVIIASRVPQAVFCLLTALQIHDLTTQLPRKVWIAMPKGSHAPKMDYPPLKMVQYSDEAFSEGIEIIESDNIKLRVYNRAKTIADCFKHRNKIGLDVAIEALKEAYTKNKVTVDELWHYAKICRVANVMRPYIEAIQ

SEQ ID NO: 8377 - protein, 197 aa, Lentisphaera araneosa HTCC2155
MNQDQALEFLRSNNGIHRTRDILNAGIAPKTLYRLRDQGHIYSLSRGLYRINEESMGAHSTYVELAHKIPKAVFCLISALHFHEIGTQLPYDHWISLPQGVKEAKLEEYDIQYIHPSKKLYQLEIEEHNISGATIKVYSPTKTVVDCFKHRNKVGIDVALEALREAIQLKKTSRKELIELATKCRMKNVMMPYIESI

SEQ ID NO: 8378 - protein, 197 aa, Lentisphaera araneosa HTCC2155
MKQEQALEFLRSNNGVHRTRDILNAGIAPKTLYRLRDRGQVYSLSRGLYRINEEGMDAHSTYVELAHKIPKAVFCLISALHFHEIGTQLPYDHWISLPQGVKEAKLDEYDIQYIHPNKELYQLGIEEHDISGATIKVYSPTKTVVDCFKHRNKVGIDVALEALREAIQLKKTSRKELIELATKCRMRNIMMPYIESL

SEQ ID NO: 8379 - protein, 150 aa, Mariprofundus ferrooxydans PV-1
MAANAELSEKQTVVEVCKRIPKGTVCLLSALAMHELTTQAPFEVWLAIDRKDWLPQVKDLPIRIVRFSGDALKSGIEHRVIDGVSIPVYNPAKTVADCFKYRNKIGLDVAIEALKDGWKARKFTMDEIQKYAVICRVQNVMRPYLETLIA

SEQ ID NO: 8380 - protein, 221 aa, Methylobacterium extorquens AM1
MPSPAQQHAAAIAAIVADGRLHTSAEFTSAGIHPVYLAKALADERVVQYGRGIYFGSWEQATEHVDLAAVSLSYPGGVVCLGSAAQVHNLSNEDPPEIFYAVEKAKIRRKLKVGPSVPVQGVYWKARDLEVGIEVRTIMGVDVRITDPARTVVDLLRYRNRLGDEPGTKALTDYLRDRHGTVRALWKAAQALDCEDQVEPFLRFAEEVVEAIPPPGRSPGV

SEQ ID NO: 8381 - protein, 187 aa, Mobiluncus mulieris ATCC 35239
MKEDGVVLVLDALAPKRSSLYRGLARGEWERVARGIYVPAGMPLMQPEWLEAVTRRAEATICLTSALAYWDLTDEIPDQVHVAIWKGARKPATRSPLAWHHFDRDSFGEERRELEIPGSDGRMIGIYGPERSVVDCFRLRALVGYETATVALHELLARGGDRALLMRLAMRLPRARRPLLDILEALN

SEQ ID NO: 8382 - protein, 187 aa, Mobiluncus mulieris ATCC 35243; identical to SEQ ID NO: 8381

SEQ ID NO: 8383 - protein, 187 aa, Mobiluncus mulieris FB024-16; identical to SEQ ID NO: 8381

SEQ ID NO: 8384 - protein, 104 aa, Mycobacterium leprae Br4923
MNEPHHAILTDLLNTFRFSEVLQHIDEYQLRQSIAGQKVTPLARELYRKIDCYSEEDLVEIAAKSLRATIALHSAVGQPQTSSGIIDITIPRGLWTPQIKIPIR

SEQ ID NO: 8385 - protein, 104 aa, Mycobacterium leprae; identical to SEQ ID NO: 8384

SEQ ID NO: 8386 - protein, 202 aa, Mycobacterium marinum M
MIICRRSVPYFEERRWLVEALTPRTAGQAGLSRSALYRGARAGRLDRIARGIYLPADASTADWDQIEAATRRPDATICLTSALAHYDLTDAIPAALDVAIPRGSRTPASTGAIAWHQFDRATFQIGREQIAIPGSDQTIGIYSPERSIADAFRQRGEVGYELARDALREWLRRGGKPARLIDIASRLPRAKSPVLQALEMLG

SEQ ID NO: 8387 - protein, 193 aa, Nakamurella multipartita DSM 44233
MPGSSDRELPNTFTAAQAEQSGLSRRGLASLQHAGEVERIGHGLFRRTSAPLVDLDLVEIAVKAHKPTLCLVSALARHDLTDQIPAKHDIAVPRGQWQPKVSAPVRWHKFDPVTFDVGRTEITVDGDYTMGLYDAPRSIIDAFRMRTTLGPDVANEALRRWLRQGGQANLLLRHVKSFPRTRTAVLTALQILL

SEQ ID NO: 8388 - protein, 207 aa, Nitrosococcus halophilus Nc4 uid46803
MTQETTANKGSIDAAIHLFSCHGGVLCTRDALRLGIHPRTLYAMRDAGLLERLSRGLYRLADLPPLGNPDLVAVALKVPGGVICLISALDYHELTTQIPHEVYLALPRGAEPPRLEHPPLRVFWVGGKAFTEGVETHEVDGVPVRIYGAEKTLADSFKYRNKIGLDTAIEALRRYVRCGRTRIDMLMAYARICRVEKVIRPYLEALL

SEQ ID NO: 8389 - protein, 191 aa, Olsenella uli VPI, DSM 7084
MGIPRDALHDAVESGRIERIVRGAYRMVGSGSSFTDELAAIWKLTEPAKFTHERLRASEWDGIVVGGSTASALLEIGDLHLSPYRLYAPKRINTRNPSASFAKRTVPRSDVMFSHDLPVTRPERTVFDLVVDDEDLSLIADVLKDAWHANRDFDFKRLAGLLRSHYGEARAESLYRGLLEDSGLRDKEGTP

SEQ ID NO: 8390 - protein, 203 aa, Chlorobium luteolum DSM 273
MSQQSTVADKAKALILAQGGLIRTREAISLGIHPRTLYSLRDSGELEELSRGIYQLKGWKQLEYPDLVTVALRVPNGVLCLVSALSFHEMTTQVPHSVSLALEKGAEQPRIEYPPVTVFRFSPSCFKIGIETHQLDGVSVKIYSPEKTLVDCFKFRNRIGMDIVLEALKLYRQRVQKNLHALMQYAEVCRVASIMKPYLEATL

SEQ ID NO: 8391 - protein, 203 aa, Pelodictyon phaeoclathratiforme BU 1
MSQQSRVADKAKALILAQGGLIRTREAISLGIHPRTLYTLRDSGELEELSRGIYQLKGWKQLEYPDLVTVALRVPNGILCLVSALSFHEMTTQVPHSVSLALEKGAEQPRIEYPPVTVFRFSPSCFKVGIETHQLDGVPVKIYSPEKTLVDCFKFRNRIGMDIVLEALKLYRQRVQKNLHALMQYAEVCRVASVMKPYLEATL

SEQ ID NO: 8392 - protein, 223 aa, Phenylobacterium zucineum HLK1
MALLQDLGLCEHSPRIYNTPMEPRGHRQRAIEVARAQGIARGSDFDAAGVPRMYLKRLTEDGVLLQVGRGLYRLADSPSDAASSLAEAVRIQPRGVIGLLSALQYHDLTTQTPHAVWMLLGPKDWAPTSAPVQIRVIRASGRALREGVERHEIDQVPVPITSPAKTVVDCFKYRNKIGLDVAVEGLRDLMRRPDRRPAIDELWRFAEIDRVQTVMRPYLEALT

SEQ ID NO: 8393 - protein, 202 aa, Polaromonas naphthalenivorans CJ2
MMPQPTQTQRVLELARQHGLLRSRDLQAVGAPRVMLTRLMASGQLEKVGRGLYRLPQTQMSEDESLAAIAIKVPQAVFCLLTALQFHGLTTQLPRQVWLAMPRGSHAPRIDYPPIRMVQYSGQSYSQGIEVFERDRVLLRVYSVAKTVVDCFKHRSAIGLDVALEALREARASQRARADELWRFAKICRVANVMRPYLEAIG

SEQ ID NO: 8394 - protein, 67 aa, Polaromonas JS666
VEVPVFNAAKTVADCFKYRNKIGLDVAMEALRDGWTQRKLTMDALWHYATIDRVANVMRPYLESATA

SEQ ID NO: 8395 - protein, 206 aa, Propionibacterium freudenreichii shermanii CIRM BIA1 uid49535
MSSVSDLVTLGRIAANQQGLVTATQARAAGVDTRQIWRLSRAGALERVIRGVYRVCGAPATDFQEITATWLALSNPGRRLTAAGTTAATLYGIGDFLRTVPEFIVAGDPSTTVENVRLRTGHVDQPRVRTLHGVPTLSPEQTIADLLAQHNDVSLVGDATVDALDKHLTTPQRVARALAPMAADHGLPDGDGSELLASILPAATAA

SEQ ID NO: 8396 - protein, 207 aa, Raphidiopsis brookii D9
MNKGKVAETASERAVRLIKKKGTTIIRTAQALQVGIHPRTLYQLRDNGVLEQVSRGVYRLSEQPYFSQPDLVTVALRIPKGIICLVSALAFHELTTQIPHTVSIALAKGAQSPRIDYPPVSVHRFSGASLKTGIEVYEIDEVPIRIYSAEKTLADCFKFRNKLGMDVVLEALKLYKTRKKFNPRQLIEYARICRVEAAMKPYLEVLV

SEQ ID NO: 8397 - protein, 205 aa, Rhizobium leguminosarum bv  trifolii WSM1325
MPSSDTQRQIARTVLTERGIARLRELRNAGVTGATMSRMERDGEVLRLARGLYQLPDAELDVNHSMAEVAKRAPKAVICLVSALAFHGLTDQLPRQIWLAIGRKDWAPKPDGPAMRIVRFTESLLNESVETHVIEGVPVKVFGIAKTIADCFRYRNKIGLSIAMEGLQEALRQRRTSPGEIANQAERGGVGSVIRPYLEALTANG

SEQ ID NO: 8398 - protein, 206 aa, Rhizobium leguminosarum bv  trifolii WSM1325
MTFTTAQRLRALDLLKARGMLRLKDFVAEGIGPETLARLVREEAVVRPARGLYQLPDTQAEAAHALAEAAVLVPKGVVCLTSALQYHELTLQMPSAVWMAIDRTAWRPKIDYPPIKFVRFKGSALTEGVERHRIEGVEVPITNPARSIVDCFRYRAKVGLDVAMEGLREGLRRRKTTSDDLWTYAKEARIWSIMRPYVEATVADGA

SEQ ID NO: 8399 - protein, 206 aa, Rhizobium leguminosarum bv viciae 3841
MTFTTAQRLRALDLLKARGMLRLKDFIAEGIGPETLARLVREEAIVRPARGLYQLPDTQAEAAHALAEAAVLVPRGVVCLTSALQYHELTLQMPSAVWMAIDRTAWRPKIDYPPIKFVRFKGSALTEGVERHRIEGVEVPITNPARSIVDCFRYRAKVGLDVAMEGLREGLRRRKTTSDDLWTYAKEARIWSIMRPYVEATVADGA

SEQ ID NO: 8400 - protein, 191 aa, Agrobacterium radiobacter K84
MTARGIARLVELRDAGVTAATMSRMERDGEVLRLARGLYQLSDAPLDANHSLAEAAKRLPKGVVCLVSALAFHGLTDQLPKQVWLAIGRKDWAPKPDSTPIRIVRFTDRLLNESVETHVVEGVPVKVFGIVKTIADCFRYRNKIGLSVAIEGLQEVLRQRKATPGEIARQAERGGVATVIRPYIEALTANG

SEQ ID NO: 8401 - protein, 170 aa, Sinorhizobium fredii NGR234
MSRMERDGEVLRLARGLYQLPDAELDANHSLAETAKRVPKAVVCLVSALAFHGLTDQLPRHVWLAIGRKDWAPKPDGTPIRIVRFTESLLHDGVETHLVEGVPVKVFRVAKTIADCFRYRSKIGLSVAIEGLQEALRQRKATPGDIANQAERGGVGTVIRPYLEALTANG

SEQ ID NO: 8402 - protein, 214 aa, Rhodomicrobium vannielii ATCC 17100
MNTRYPTQQDRAIALLAERGMAKLSEFTASGITAATISRMKERGLILQLSRGLYQLPDAPLDGNHSLAEAAKRVPKGVICLVSALAYHELTDTIPRLVWIAIGARQKKPVVKTPPLNIVRFGQMVFSTGIEEHMIEGVRVRIYSPAKTVVDLFRYRQREGRRYKSSPGINPVLEGMREALRQRKATPADIARYAMEAGVWSNLRPYLEAMTSHA

SEQ ID NO: 8403 - protein, 205 aa, Rhodopseudomonas palustris DX-1
MPQTRSQREIARDLLEVRGILRLAELRAAGVTAATVSRMEKDGEVTRLARGLYQLADAELDANHSLAEAAKRFPKGVICLVSALAFHGLTDQLPRKVWMAIGRNDWTPKPSDMPIRVLRFSDDLLADSVEPHVIEGVSVKVFGVAKTVADCFRHRGKIGLPVALEGLQEALRQRKATPAEIARAADTGGVGTVIRPYLEALTANG

SEQ ID NO: 8404 - protein, 220 aa, Rhodopseudomonas palustris DX-1
MNHTCSMTACSRTQSERVELLLRERGLVRAAEFRREGISPTTISRMKERGDIVQLSRGLYQLAGAAPGVGSSLAEAAKLVPKGVVCLVSALAFHELTDTIPPRIWIAIGPKDWKPRVTQPPLQFVRFGGKVLRSGIEEHRIEGVTVKVYSPAKTVVDLFRYRQSEGRRFKRSPGLSLALEGMKEALRKRKATPAQIAKYAEEAGVWKVVRPYLEAMTADG

SEQ ID NO: 8405 - protein, 229 aa, Slackia heliotrinireducens DSM 20476
MSYSSNISAIEELAASEGGIFTSGQAARAGVPRYALSYAAKSGRIERLRHGAYRLSSLPTTALDDLVAAYKLTSPDRLTYERMGASFDGVAVCGATAAHALGIGDLEPEPWQIAVPKRFNSRMDGTKFRVMDLGRSDVVWAEGGFPVTRVERTIADLAMEATEESLLADVLADAIRRYGATELDMRRLRALLGDGRLRSLLSAAGAYEGGPRELVELDGLGHAALIERG

SEQ ID NO: 8406 - protein, 202 aa, Synechococcus sp. RS9917
MLPVLDRKETALKLARSRGLLRAREAAAAGVDRSTLARLCDSGLLERLERGLYGLPAAAVREHVDLEIVAKRVPQAVFCLLTALRLHGLGTQQPRRVWISLPRGVHRPTLQFPPLEVIHVQPELHRLQVESRRSGPIRLKIYGVEKTLVDCFRHRRRLGMEPVLEALKDAISQRRLNVDELWRQAQAQRMQRVMTPYLEALL

SEQ ID NO: 8407 - protein, 200 aa, Syntrophobacter fumaroxidans MPOB
MAPTTTEQVLDLVEKAGVFRPRELDSYGIPREYLVRLCRKGLVRRVARGLYTFVDSDVSEHLSLAEASKKIPHGVICLLSALRFYGLTTQAPFEVWVAVDVKARKPRSDGLPLRIVRFSGAALRSGVEDQLIQGVKVRVYSPAKTVADCFKYRNKTGLDVALEALRECWRERRCTMDDLWRYAKICRVSNVMRPYLESLP

SEQ ID NO: 8408 - protein, 205 aa, Variovorax paradoxus S110
MALHSDPTLEQAALALAERQPLLRARDLATHGLPTVVLSRLVAAGRLERVARGVYSLPGRALSEHRSLAEAALRVPRGVVCLLSALRAHGIGTQAPFEVWMAIPHHSPTPRLDQPALRVVRMSGAALTEGVDLVDTDGVQVPVFNAAKTVADCFKYRNKIGLDVALEALRDGWSQRKLSMDALWHYATVNRVANVMRPYLESVIA

SEQ ID NO: 8409 - protein, 207 aa, Verrucomicrobiales sp. DG1235
MADTLQTTPKKTEQLAEEFKTTSTLTSSELQELGYSRTVISKAIQLGHIERLSRGLYTSRHAPISEHTSLVQVAKQTPNARICLLSALKFHELTSQNPHEVWIAIDRKARKPSYKSPPTQVVRFSGQAYETGIEIHSIEGTEVAIYSVSKTVVDLFRYRNTIGIDVAIEALKEGWKERRFTIAEINKIAKSCNAATTLSPYLETVLG

SEQ ID NO: 8410 - protein, 199 aa, Xanthomonas oryzae MAFF 311018
MDTTVDKLLELVRTRGLLRPHDLAPLGIPRVALTRAVRRGQLERVGRGLYGLVARPVSAHGTLAEVARRVPKGVVCLLSALRVHDLTTQAPFEVWLAIDNKAAAPKLDYPPLRLVRFSGPALSEGVEEHVVDGVPVHVTSVAKTVADCFKYRNKIGIDVALEALREAWVARRMTSDEIWHYAKIDRVANVMRPYLESLA

SEQ ID NO: 8411 - protein, 201 aa, Xanthomonas oryzae pv oryzicola BLS256
MLSDTHTQRVLDLASQKGLLRASNLDAINAPRVVLTRLTAAGVLERVGRGLYRLPDAQGSEFESLAAIATKVPQAVFCLLTALQFHELTTQLPRQIWIAMPRGSHAPRIGYPPVKMVQMTGDVYAAGIEEHLRDGVKLRVYGAAKTVVDCFKHRNKIGLDVALEALKDVRAKRKATADDLWRFATVCRVANVMRPYLEAVE

SEQ ID NO: 8412 - protein, 272 aa, Xanthomonas oryzae KACC10331
MLSGPTTTIRPCCGSSPGQQTSRPPARREGQGWRARYACLIGNRIRRQFAQWRGSYPSVVIDIYRFYGTICRIMDTTVDKLLELVRTRGLLRPHDLAPLGIPRVALTRAVRRGQLERVGRGLYGLVARPVSAHGTLAEVARRVPKGVVCLLSALRVHDLTTQAPFEVWLAIDNKAAAPKLDYPPLRLVRFSGPALSEGVEEHVVDGVPVHVTSVAKTVADCFKYRNKIGIDVALEALREAWVARRMTSDEIWHYAKIDRVANVMRPYLESLA

SEQ ID NO: 8413 - protein, 199 aa, Xanthomonas oryzae PXO99A
MDTTIDKLLELVRTRGLLRPHDLAPLGIPRVALTRAVRRGQLERVGRGLYGLVARPVSAHGTLAEVARRVPKGVVCLLSALRVHDLTTQAPFEVWLAIDNKAAAPKLDYPPLRLVRFSGPALSEGVEEHVVDGVPVHVTSVAKTVADCFKYRNKIGIDVALEALREAWVARRMTSDEIWHYAKIDRVANVMRPYLESLA

SEQ ID NO: 8414 - protein, 184 aa, Xylanimonas cellulosilytica DSM 15894
MTVLTLDSARAAGLRKEEVYRMVEAGELERIGRGVYIRPGQVDPFLASLAGATAVKPMATMCLTSALVHHGLSDEIPFDTDVALPRGTRFPAGFEHVRWHSFDPSTFTAGRRRLAHDLELWVYSAERTIVDAYRLAHREGVDQAHEALRRWVRTPGNSPASLLRTAALFPRSVTTIRETLQVLL

SEQ ID NO: 8415 - protein, 224 aa, Opitutaceae sp. TAV2
MGLRIQLESLLRFHTINKKVKMKRNSGTRLKKAGDRARRLGIFRARDMVAAGYPREYLRRLVGQEQVRQLGRGLYASADFDGDQNLTLVEAAKRVPRGVVCLVSSLQFHRIGTQSPHQVWLALPRGSNFPRVDDLPLRFCKFSDTAYAFGVQEHAIPGGIVRIYSPAKTVADCFKYRHKYGLDVAVEALREGWHGKKFTLWELSAAAAVCRVGRVLQPYLEMLT

SEQ ID NO: 8416 - protein, 433 aa, Acinetobacter johnsonii SH046
MDTISTNTQAILLLTAPLILGKGSQSFDLLTTKEYNLLARYLWKIGKQPSDLLSSDAKDLIEKCSNLINPERLNILLNRGFLLSQVIELWQSRSIWVISRADKAYPRLIKDKLKDQSPPILYGFGNLDLLNSGGLAVIGSRKIDDSIYNYSNNIGKLAAKFGTKVISGGAKGVDQAAMYGALHEGGYVCEVMAENLERAVLDAGRRNYLMSGNLILVSAYDPKASFNIGHAMQRNKLIYALSDASLVVASDFNKGGTWAGAAEQLDKLKFVPVYVRLDNESKGLRELYKKGAIPWPNPQDINSFRQIFDVSNLANNNLNLSLFDQEDIVKEFKVSDIAQQNLTNTIDESTKSHTPSATNTSEIEVQKPADELFEFAANIILNLLDTPLKDSEISQALNISLAQTKLWLSRLVEEERIEKRTKPVTYIVRHSKS

SEQ ID NO: 8417 - protein, 433 aa, Arthrospira platensis NIES-39
MSNHQLSQDTQGILLLCGSFGKSRNHSPQPLSLREYNLLAAALRSHQMTPAHLLAPDGEQKLCSLNHSLDNQRIIELLQRGFLLTLSLEKWRSQGLWIVSRSDRHYPQRLKQHLKYLSPPILYGVGNLELLNKGGLAIVGSRNVNEAVLSYTQQLAHISAQQNIQVISGGARGIDKCGMLSCLEAGGTTIGVLANSLGKASLESDYRQSLDEDRLALISPYDPEAGFHVGNAMGRNKYIYALADYAVVISASFNKGGTWSGAVEALKKLPNIPVFVCQNSQNQGNMELLKLGAKPFPEMSGKLDLLDILKPGETEDAVEVEQMALDFAVNLTPENPAPTPIYVDVNPTPTEAPNVSPSPELSEAKIDVSMDIYQAVLPIILTHLQEPIDAKNLAKLLDVQYNQIQAWLKRAIEDGKVTKLTKPVRYVSSECNR

SEQ ID NO: 8418 - protein, 439 aa, Chlorobium phaeobacteroides DSM 266
MQKLSSNTKAILLLTAPLIASHGSLLPDLLSPSEYNRLARHLHDMQREPADLLLPDAGDLHRACKHLVDEKRLQSLLERGFLLSQVIEHWQARAIWVVSRADAAYPRRLKARLREGAPAVLYGCGDINLLEAGGLAVVGSRHVDDEQINYTMAIGQLAALADRMIISGGAKGIDQAAMQGALEADGKVCGILADRLERTAMNREHRNLIIEERLVLVSPYDPSAGFNVGHAMQRNKLIYALADASLVINSDINKGGTWAGATEQLDKLRLVPVYVRSTGTASRGIDALRNRGALPWPEPHDVKAFEALLDTSPSLIPVGRDVSIGLFPNGMVQDSVTDTVQEKPQVQVMQEISLPVLVSGKAELSPAQRLFATVREVIRQLLKKPMTDTEIAERLELSTLQTRVWLQLLVDEGILEKKNKPVRYFIKEPGFFENGHHAT

SEQ ID NO: 8419 - protein, 426 aa, Cyanothece PCC 8801
MLSPDTQAILLLCASFGQNRQTEPFPLTLGEYNTLAGWLRAENMFPQDLLNPNFISRLSQLTIGKLDSKRLVALLQRGGLLALTVEKWLNQGLWIISRGDADYPLRLKQQLKYLAPPILYGIGNKDLLSKGGLAVVGSRNVDQEGLDYTYHVVEACAEQNIQVISGGAKGVDQASMLGTLKVGGTVIGVLANNLLKASVDGKYRTSIKEGKLTLISAVDPNASFHVGNAMRRNKYIYALANYGLVISADYNTGGTWAGATEALNTIKDVPILVRIQGTISEGNQHLLKQGAKPFPETPWNRPIKELIETTVSEYKSIEFRQNNTQLNLFSQDNHSVVSDNKDELTPQDPDISSRDDALKSASERLYYAVLPIILQELNQPQDPKSLATNLDVQVGQLSKWLKKAVTDKKVIKQTKNNQVIYKSNKV

SEQ ID NO: 8420 - protein, 421 aa, Dehalogenimonas lykanthroporepellens BL DC 9 uid48131
MNTISENTQAILLLTAPLIVSRGAVPTNILTHTEYKKLATCLMTLEKEPADLLGEKSEELLDALTGLFDKSRLGSLLERGFLLSQATDYWAARGIWVISRADQEYPSRFKAKLKDNSPAILYGCGDPSILEGGGLAVVGSRKVDEQLRDYAQKVGRLAAAGNIGIVSGGARGIDRASMRGALECEGRAVGVLADSLTKASVERENRQFFIDERLVLITPFNPSAGFNVGNAMNRNKLIYALADAALVVNSDYKTGGTWAGAYEQLKKLKYARVFVRNSKGESKGLEELSKLGAEEWPEPEDKYDLQNILMNSPQKEQPVQPEMPMIAEDQAIPEVAIITDEPKSNQNNPEPDEEVVTEDLGTRILKALKKDPTPTTPTSLIKTLGVKNTEINSCLKALLKEGKVQKLTNPVRYTIMPPKMI

SEQ ID NO: 8421 - protein, 413 aa, Desulfitobacterium hafniense DCB 2
MNNMLSQDSLAMVLLCTTVGLSKDNTEIRPLTIKQWNQFLRRMFNAEIKNPAALFEVGKEDLKKRLGLSDEESQRIQFLLSRAGQAVVELENLNNMGIFVTTRAEKSYPQRLKSVLKKDSPPVLFYSGDIELTQMEGIGIVGSRNIDPKGLEFTKELGSKSAKQGLTVISGGAKGVDEVAQNEALRQGGKVISILADSLAQKIKHKEAREAIMEQRLLLLTSFHPRAPFTVYNAMQRNKYIYALSHIAVVVSSDYSKGGTWAGATENLRNKWVPLFVRKDDIVPEGNEKLLKMGANPLSAKDLFSESFNANRLSSLADQYYEQGSLFSVSNLLEKETDYQVSNDSGESDHEERIDLFPVIWPYLESALQKARTKEELCTMLHIHGNQMKIWLERALAEQKIKKTRKPAGYIVQ

SEQ ID NO: 8422 - protein, 401 aa, Desulfitobacterium hafniense Y51
MLLCTTVGLSKDNTEIRPLTIKQWNQFLRRMFNAEIKNPAALFEVGKEDLKKRLGLSDEESQRIQFLLSRAGQAVVELENLNNMGIFVTTRAEKSYPQRLKSVLKKDSPPVLFYSGDIELTQMEGIGIVGSRNIDPKGLEFTKELGSKSAKQGLTVISGGAKGVDEVAQNEALRQGGKVISILADSLAQKIKHKEAREAIMEQRLLLLTSFHPRAPFTVYNAMQRNKYIYALSHIAVVVSSDYSKGGTWAGATENLRNKWVPLFVRKDDIVPEGNEKLLKMGANPLSAKDLFSESFNANRLSSLADQYYEQGSLFSVSNLLEKETDYQVSNDSGESDHEERIDLFPVIWPYLESALQKARTKEELCTMLHIHGNQMKIWLERALAEQKIKKTRKPAGYIVQ

SEQ ID NO: 8423 - protein, 428 aa, Desulfotalea psychrophila LSv54
MSNYLTDDTKAIILLCGFFGKDSSTKPLSQGDYNKLVDWLISSGMRPKDLLQQENIDPAAKGSGIYQQRLEALLGRGVQLGFAVEEWQRNGIWIISRSDTDYPTRYKNHLGKQAPPLLFGVGDRSLLTGGGLAIIGSRNVDEIGGNFTREVGALCAQNRMPVVSGGARGVDQFSMTAALDAGGMTIGVLADSLLKKSLERTARKAIARGRLLLISACHPNARFTVGTAMGRNKLIYAMADYGLVVSAEHKKGGTWAGADEELKREHSIPVFVRQGNDVPLGNSKLLGLGAIAWPDKVDHQNLRGQLTELSSQCAQKSTQKNMSLLDFQERQKEPAKELPKAESIELTESSNVVEDTAAKHSVTTVYETVLPLILEKLESPTTVDELISSLDVVKTQLNVWLKKALEEKRVVKLTRPVKYQRISSKEQT

SEQ ID NO: 8424 - protein, 453 aa, Desulfotomaculum acetoxidans DSM 771
MKNNLSEDSLAILLLCSNLATYGKTGSFFKPFTLKEWDSLSHKIIESVMKRPGAFFYTTPEEWRECLNLTPENIQRIQNLLTEGGQLGIELERLSSLGIWVTTRAEASYPARLKKVLRQKSPVVLFGAGDASLFQSEGVAIVGSRNVDEIGSYFAEKLAGRCVTEGLTVVSGGARGVDMIAQNSALRSGGKVISVLSNSMETSIRQRENREAIVAGRLLLLSSTHPKAPFNVYNAMDRNKYIYALSHYAVVVSSEENKGGTWTGATENLKAGWVPLFVRVGGQVPAGNNRLLEKGAIAFDSEVLADEAVILRNWLSDNIQVIVNYESSKRNENNISSPKKDHQLAFRFDDSTVSHQILDNPEQLFAGNDLFTVVWPYIEKVLEKSQKTEKELAEMFNVRSVQIQDWLKRAVDEQKVKRLIKPVRYVVASYGPSGQERLPVGNIEQAVVFESCE

SEQ ID NO: 8425 - protein, 400 aa, Escherichia coli 83972
MNLSANAQATLLLTSDFSRAAASEYKPLSNSEWGKFALWLKHQRISPAELLVPQPQEKLTGWSDPRISQERILGLLARGHSLALAVDKWQRAGLWILTRGDADYPVRLKNRLRTDAPPVLFGCGNKALLQAEGMAIVGSRDAPTDDLRYTQQLAAKLAQQGICVISGGARGIDECAMASALEVGGTAVGVLADSLLKTSTLVKWREGLIAGNLVLISPFYPEVRFTVGNAMARNKYIYCLAESAMVVRAGMTGGTITGAMEALKHQWLPMQVKPNQDMQSANSRLVENGASWSAEQAENVTIRLPDVPGLMYDRALRNAQPELFSLHEDDANYAVMPAHTPVDFYQLFVAELAILAKESISIERLASCTGLTIEQISVWLNRAEEEGRVIRLGEGHYQFR

SEQ ID NO: 8426 - protein, 401 aa, Escherichia coli ABU 83972
MMNLSANAQATLLLTSDFSRAAASEYKPLSNSEWGKFALWLKHQRISPAELLVPQPQEKLTGWSDPRISQERILGLLARGHSLALAVDKWQRAGLWILTRGDADYPVRLKNRLRTDAPPVLFGCGNKALLQAEGMAIVGSRDAPTDDLRYTQQLAAKLAQQGICVISGGARGIDECAMASALEVGGTAVGVLADSLLKTSTLVKWREGLIAGNLVLISPFYPEVRFTVGNAMARNKYIYCLAESAMVVRAGMTGGTITGAMEALKHQWLPMQVKPNQDMQSANSRLVENGASWSAEQAENVTIRLPDVPGLMYDRALRNAQPELFSLHEDDANYAVMPAHTPVDFYQLFVAELAILAKESISIERLASCTGLTIEQISVWLNRAEEEGRVIRLGEGHYQFR

SEQ ID NO: 8427 - protein, 400 aa, Escherichia coli B088
MNLSANAQATLLLTSDFSRAAASEHKPLSNSEWGKFALWLKHQRISPAELLVPQPQEKLTGWSDPRISQERILGLLARGHSLALAVDKWQRAGLWIITRGDADYPVRLKNRLRTDAPPVLFGCGNKALLQAEGMAIVGSRDAPTDDLRYTQQLAAKLAQQGICVISGGARGIDECAMASALEAGGTAVGVLADSLLKTSTLVKWREGLIAGNLVLISPFYPEVRFTVGNAMARNKYIYCLAESAMVVRAGMTGGTITGAIEALKHQWLPVQVKPNQDMQSANSRLVENGASWSAEQAENVPIRLSDVPGLMYDRALRNAQPELFSLHEDDANYAVMPAHTPVDFYQLFVAELAIFAKESISIERLSSCTGLTIEQISVWLNRAEEEGRVIRLGEGHYQFR

SEQ ID NO: 8428 - protein, 431 aa, Escherichia coli B185
MDADSSDSTVTPGRLPDGLSSCPCFYLGKKLMNLSANAQATLLLTSDFSRAAASEYKPLSNSEWGKFALWLKHQRISPAELLVPQPQEKLTGWSDPRISQERILGLLARGHSLALAVDKWQRAGLWILTRGDADYPVRLKNRLRTDAPPVLFGCGNKALLQAEGMAIVGSRDAPTDDLRYTQQLAAKLAQQGICVISGGARGIDECAMASALEAGGTAVGVLADSLLKTSTLVKWREGLIAGNLVLISPFYPEVRFTVGNAMARNKYIYCLAESAMVVRAGMTGGTITGAMEALKHKWLPVQVKPNQDMQSANSRLVENGASWSAEQAENVTIRLPDVPGLMYDRALRNAQPELFSLHEDDANYAVMPAYTPVDFYQLFVAELAILAKESISIERLASCTGLTIEQISVWLNRAEEEGRVIRLGEGHYQFR

SEQ ID NO: 8429 - protein, 431 aa, Escherichia coli IAI39
MDADSSDSTVTTGRLPDGLSSCPCFYLGKKLMNLSANAQATLLLTSDFSRAAASEYKPLSNSEWGKFALWLKHQRISPADLLVPQPQEKLTGWSDPRISQERILGLLARGHSLALAVDKWQRAGLWILTRGDADYPVRLKNRLRTDAPPVLFGCGNKALLQAEGMAIVGSRDAPTADLRYTQQLAAKLAQQGICVISGGARGIDECAMASALEAGGTAVGVLADSLLKTSTLVKWREGLIAGNLVLISPFYPEVRFTVGNAMARNKYIYCLAESAMVVRAGMTGGTITGAMEALKHQWLPVQVKPNQDMQSANSRLVENGASWSAEQAENVTIRLPDVPGLMYDKALRNAQPELFSLHEDDANYAVMPAHTPVDFYQLFVAELAILAKESISIERLASCTGLTIEQISVWLNRAEEEGRVIRLGEGHYQFR

SEQ ID NO: 8430 - protein, 400 aa, Escherichia coli MS 185-1; identical to SEQ ID NO: 8425

SEQ ID NO: 8431 - protein, 400 aa, Escherichia coli MS 200-1
MNLSANAQATLLLTSDFSRAAASEYKPLSNSEWGKFALWLKHQRISPAELLVPQPQEKLTGWSDPRISQERILGLLARGHSLALAVDKWQRAGLWILTRGDADYPVRLKNRLRTDAPPVLFGCGNKALLQAEGMAIVGSRDAPTDDLRYTQQLAAKLAQQGICVISGGARGIDECAMASALEVGGTAVGVLADSLLKTSTLVKWRDGLIAGNLVLISPFYPEVRFTVGNAMARNKYIYCLAESAMVVRAGMTGGTITGAMEALKHQWLPMQVKPNQDMQSANSRLVENGASWSAEQAENVTIRLPDVPGLMYDRALRNAQPELFSLHEDDANYAVMPAHTPVDFYQLFVAELAILAKESISIERLASCTGLTIEQISVWLNRAEEEGRVIRLGEGHYQFR

SEQ ID NO: 8432 - protein, 400 aa, Escherichia coli MS 21-1
MNLSANAQATLLLTSDFSRAAASEYKPLSNSEWGKFALWLKHQRISPADLLVPQPQEKLTGWSDPRISQERILGLLARGHSLALAVDKWQRAGLWILTRGDADYPVRLKNRLRTDAPPVFFCCGNKALLQAEGMAIVGSRDAPTADLRYTQQLAAKLAQQGICVISGGARGIDECAMASALEAGGTAVGVLADSLLKTSTLVKWREGLIAGNLVLISPFYPEVRFTVGNAMARNKYIYCLAESAMVVRAGMTGGTITGAMEALKHQWLPVLVKPNQDVQSANSRLVENGASWSAEQAENVTIRLPDVPGLMYDKALRNVQPELFSLHEDDANYAVMPAHTPVDFYQLFVAELAILAKESISIERLASCTGLTIEQISVWLNRAEEEGRVIRLGEGHYQFR

SEQ ID NO: 8433 - protein, 400 aa, Escherichia coli MS 45-1; identical to SEQ ID NO: 8425

SEQ ID NO: 8434 - protein, 400 aa, Escherichia coli MS 69-1
MNLSANAQATLLLTSDFSRAAASEYKPLSNSEWGKFALWLKHQRISPADLLVPQPQEKLTGWSDPRISQERILGLLARGHSLALAVDKWQRAGLWILTRGDADYPVRLKNRLRTDAPPVLFGCGNKALLQAEGMAIVGSRDAPTADLRYTQQLAAKLAQQGICVISGGARGIDECAMASALEAGGTAVGVLADSLLKTSTLVKWRKGLIAGNLVLISPFYPEVRFTVGNAMARNKYIYCLAESAMVVRAGMTGGTITGAMEALKHQWLPVLVKPNQDVQSANSRLVENGASWSAEQAENVTIRLPDVPGLMYDRALRNAQPELFSLHEDDANYAVMPAHTPVDFYQLFVAELAILAKESISIERLASCTGLTIEQISVWLNRAEEEGRVIRLGEGHYQFR

SEQ ID NO: 8435 - protein, 400 aa, Escherichia coli O103 H2 12009
MNLSANAQATLLLTSDFSRAAASEHKPLSNSEWGKFALWLKHQRISPAELLVPQPQEKLTGWSDPRISQERILGLLARGHSLALAVDKWQRAGLWIITRGDADYPVRLKNRLRTDAPPVLFGCGNKALLQAEGMAIVGSRDAPTDDLRYTQQLAAKLAQQGICVISGGARGIDECAMASALEAGGTAVGVLADSLLKTSTLVKWREGLIAGNLVLISPFYPEVRFTVGNAMARNKYIYCLAESAMVVRAGMTGGTITGAIEALKHQWLPVQVKPNQDMQSANSRLVENGASWSAEQAENVPIRLSDVPGLMYDRALRNAQPELFSLHENDANYAVMPAHTPVDFYQLFVAELAIFAKESISIERLSSCTGLTIEQISVWLNRAEEEGRVIRLGEGHYQFR

SEQ ID NO: 8436 - protein, 400 aa, Escherichia coli O150:H5 SE15; identical to SEQ ID NO: 8425

SEQ ID NO: 8437 - protein, 431 aa, Escherichia coli O157:H7 EC4076
MDADSSNSTVTPGRLPDGLSSCPCFYLGKKLMNLSANAQATLLLTSDFSRAAASKYKPLSNSEWGKFALWLKHQRISPAELLVPQPQEKLTGWSDPRISQERILGLLARGHSLALAVDKWQRAGLWILTRGDADYPVRLKNRLRTDAPPVLFGCGNKALLQAEGMAIVGSRDAPTDDLRYTQQLAAKLAQQGICVISGGARGIDECAMASALEAGGTAVGVLADSLLKTSTLVKWREGLIAGNLVLISPFYPEVRFTVGNAMARNKYIYCLAESAMVVRAGMTGGTITGAMEALKHQWLPVQVKPNQDMQSANSRLVENGASWSAEQAENVTIRLPDVPGLMYDRALRNAQPELFSLHEDDANYAVMPAYTPVDFYQLFVAELAILAKESISIERLASCTGLTIEQISVWLNRAEEEGRVIRLGEGHYQFR

SEQ ID NO: 8438 - protein, 431 aa, Escherichia coli O157:H7 EC4113; identical to SEQ ID NO: 8437

SEQ ID NO: 8439 - protein, 431 aa, Escherichia coli O157:H7 EC4196; identical to SEQ ID NO: 8437

SEQ ID NO: 8440 - protein, 431 aa, Escherichia coli O157:H7 EC4401; identical to SEQ ID NO: 8437

SEQ ID NO: 8441 - protein, 431 aa, Escherichia coli O157:H7 EC4486; identical to SEQ ID NO: 8437

SEQ ID NO: 8442 - protein, 431 aa, Escherichia coli O157:H7 EC4501; identical to SEQ ID NO: 8437

SEQ ID NO: 8443 - protein, 431 aa, Escherichia coli O157:H7 EC508; identical to SEQ ID NO: 8437

SEQ ID NO: 8444 - protein, 431 aa, Escherichia coli O157:H7 EC869; identical to SEQ ID NO: 8437

SEQ ID NO: 8445 - protein, 431 aa, Escherichia coli O157H7 EDL933; identical to SEQ ID NO: 8437

SEQ ID NO: 8446 - protein, 400 aa, Escherichia coli O157:H7 TW14588
MNLSANAQATLLLTSDFSRAAASKYKPLSNSEWGKFALWLKHQRISPAELLVPQPQEKLTGWSDPRISQERILGLLARGHSLALAVDKWQRAGLWILTRGDADYPVRLKNRLRTDAPPVLFGCGNKALLQAEGMAIVGSRDAPTDDLRYTQQLAAKLAQQGICVISGGARGIDECAMASALEAGGTAVGVLADSLLKTSTLVKWREGLIAGNLVLISPFYPEVRFTVGNAMARNKYIYCLAESAMVVRAGMTGGTITGAMEALKHQWLPVQVKPNQDMQSANSRLVENGASWSAEQAENVTIRLPDVPGLMYDRALRNAQPELFSLHEDDANYAVMPAYTPVDFYQLFVAELAILAKESISIERLASCTGLTIEQISVWLNRAEEEGRVIRLGEGHYQFR

SEQ ID NO: 8447 - protein, 431 aa, Escherichia coli 536
MDADSSDSTVTPGRLPDGLSSCPCFYLGKKLMNLSANAQATLLLTSDFSRAAASEYKPLSNSEWGKFALWLKHQRISPAELLVPQPQEKLTGWSDPRISQERILGLLARGHSLALAVDKWQRAGLWILTRGDADYPVRLKNRLRTDAPPVLFGCGNKALLQAEGMAIVGSRDAPTDDLRYTQQLAAKLAQQGICVISGGARGIDECAMASALEVGGTAVGVLADSLLKTSTLVKWRDGLIAGNLVLISPFYPEVRFTVGNAMARNKYIYCLAESAMVVRAGMTGGTITGAMEALKHQWLPMQVKPNQDMQSANSRLVENGASWSAEQAENVTIRLPDVPGLMYDRALRNAQPELFSLHEDDANYAVMPAHTPVDFYQLFVAELAILAKESISIERLASCTGLTIEQISVWLNRAEEEGRVIRLGEGHYQFR

SEQ ID NO: 8448 - protein, 431 aa, Escherichia coli CFT073
MDADSSDSTVTPGRLPDGLSSCPCFYLGKKLMNLSANAQATLLLTSDFSRAAASEYKPLSNSEWGKFALWLKHQRISPAELLVPQPQEKLTGWSDPRISQERILGLLARGHSLALAVDKWQRAGLWILTRGDADYPVRLKNRLRTDAPPVLFGCGNKALLQAEGMAIVGSRDAPTDDLRYTQQLAAKLAQQGICVISGGARGIDECAMASALEVGGTAVGVLADSLLKTSTLVKWREGLIAGNLVLISPFYPEVRFTVGNAMARNKYIYCLAESAMVVRAGMTGGTITGAMEALKHQWLPMQVKPNQDMQSANSRLVENGASWSAEQAENVTIRLPDVPGLMYDRALRNAQPELFSLHEDDANYAVMPAHTPVDFYQLFVAELAILAKESISIERLASCTGLTIEQISVWLNRAEEEGRVIRLGEGHYQFR

SEQ ID NO: 8449 - protein, 400 aa, Escherichia coli SMS 3 5
MNLSANAQATLLLTSDFSRAAASEYKPLSNSEWGKFALWLKHQRISPADLLVPQPQEKLTGWSDPRISQERILGLLARGHSLALAVDKWQRAGLWILTRGDADYPVRLKNRLRTDAPPVLFGCGNKALLQAEGMAIVGSRDAPTADLRYTQQLAAKLAQQGICVISGGARGIDECAMASALEAGGTAVGVLADSLLKTSTLVKWREGLIAGNLVLISPFYPEVRFTVGNAMARNKYIYCLAESAMVVRAGMTGGTITGAMEALKHQWLPVQVKPNQDMQSANSRLVENGASWSTEQAENVTFRLPDVTGLMYDKALRNAQPELFSLHEDDANYAVMPSHTPVDFYQLFVAELAILAKESISIERLASCTGLTIEQISVWLNRAEEEGRVIRLGEGHYQFR

SEQ ID NO: 8450 - protein, 469 aa, Kingella denitrificans ATCC 33394
MTPVLSPNTQAILLLTAPLIAGRGSASSDLLSLGEYKRLARHLREIQRQPADLLSPDAAEILRACQPVIDEGRLQKLLGRGFLLSQVIERWQTRAIWVVSRADAEYPRRLKTRLREDAPAVLYGCGDMALLETGGLAVVGSRHVDDALIDYTMAVGWLAARAGRTLVSGGAKGIDQAAMRGALEGGGKVCGVLADSLEKTTMNREHRNLLLDGQLVLISPYDPSAGFNVGNAMQRNKLIYALADTSLVVSSDLNKGGTWAGAVEQLDKLKFVPVFIRSTGKSSAGLDGLRKKGALLWPNPQDVDSFEDVFNVAMPTPTASPQVGFALFSNEDPSSADTKPTTPVSPDTAPAPQAASESSAPVDVVFDAQPPAEASEELPPVTPEAVAPIDEAKEFPQPESTPAEVLFAAVRTAIQQLLSTPMKDAEVAAALDVSNAQAKAWLQRLVDEGVLEKQKKPAGYVVKQKRLFE

SEQ ID NO: 8451 - protein, 449 aa, Lyngbya sp. CCY 8106
MMVNSTVSADTEAILLLCASFGENRQTEPQPLTLREYNLLAKWLQENQMRPQDLLDKNIQIDLQNLHNDKLDPNRIQALLERGAMLAFAVEKWTNQGVWIIGRGDGKYPQFLKQRLKHSAPAILYGVGEIELLSKGGLAVVGSRDIDDEAVEYTQKIARICAEEKIQIISGGAKGVDQASMLGILEAGGTAIGVLADSLLKAATLGKYRDSIREGQLTLISTYDPNAGFSVGNAMGRNKYIYALANYALVISSSVGKGGTWAGAIEALKKMKEVPLWVRMEDNVPEGNQQLVEQGARAFRLIEWNDYLHNFLLKSPELVLQNIEDKNEQEEEKQSENQSNLEENVETHPAEIEDKLSDNESTSEENPLVEEPISSVSPAEEIYQAVLPILLKHLQEQLDDKSLAERLDVKIGQLQEWLKKAVAEDKVKKLKKPAKTYVIADKKLLDFIN

SEQ ID NO: 8452 - protein, 428 aa, Maribacter sp. HTCC2170
MISERTKAILLLTSYFSKDSDKKNKPLSLLEWNRMVRWLQSKKLKPEDLLTIDLNKLLINWNDTTIPKNRIIELLDRKMALAIRLEKWSKAGVWIINRSDKFYPNSLKNKLKDRVPPILFGIGDKNLLNKNYIGIVGSRHISETDIKVTKDIVKQLYAQNYGVVSGGARGIDEHSMTGILECNGYALGVVADSLIKKSSSSIYRKHIIDNKLVLISPFNPEVGFNVGNAMGRNKFIYILSQAAIVVKSETKGGTWEGANENLKNNWAPLWVVKPIENKTNKGNFEIVRKGGRFLHEGFNVSNIINPKDKSIKAQGSLFNYNIKIEESNIVNESEVKSIVIKSKTSLSPDNDKIRVEEITFYDLFIYKSSSYFKDKEFNREEILNHFELASKQIDDWLKVAVKDKVLLKKTRPVRYLLNPKAKIKALNV

SEQ ID NO: 8453 - protein, 460 aa, Marinobacter aquaeolei VT8
MLAAKTQAILLLTAYFSRSTSSEAKPLTNKEWGRFAFWLKNQEMVPEDLLTGDLSQKLAGWTDSKITSDRIQTLLNRGSALAMAMEKWTRSGLWVLTRSDSDYPKRLKARLGNDAPPVFFGCGNRNLLNQGGIAVIGSRKTSDADLQFSHDLGAKSANDGRSVVSGGAKGVDEAAMLGALESEGTAIGVLANDLLRAATSAKYRKYLMANNLVLLSPFYPEAGFNAGNAMQRNKYIYCLSDAAIAVHSGNSGGTWNGVLENIKHNWVPMWIKPTDDPEAGNATLVQKGAKWLPENLAEIDLDHLLRTADSSAEQGADLFAQNRTETVPEVTVNEPLAHTTGQQEENEVASNEVVKETAEDASKSSPKQEHATPSPVSSDQCEEKTALTQLSLYDHFLLMLRNETGSPKTIDELLEATQLHKTQLNEWLKQAVADDKVTKLNRPARYQWVEDNQRKMFEDQ

SEQ ID NO: 8454 - protein, 426 aa, Microcoleus chthonoplastes PCC 7420
MDYHLLSPNTQAILLLCASFGQNRQTEPKPLTLSEYNTVATWLLEEHLNPADLLNSTLKNRLSQITINKLDSQRLIALLERGVMLSLAVEKWTNQGLWILGRGDADYPQCLKQRLKHNAPAILYGIGKRELLSQAGLAIVGSREVDQEGLNYTERVVQICAEQGINVISGGARGVDQASMLGILAAGGNAVGVLADSLTKAAVASKYRAGIKEGRLTLVSAYDPDASFSAGNAMGRNKYIYALADYALVISSAVGKGGTWAGATEVLRKVQDVPVFVRMQGTVPEGNQKLLEKGGIVFPEIPWNKPLRTLLDAAIAEVEESKVDGEVIESEKSSAGDDLGGDKTIYINLPAKDIYEAVLPFILNQLEQPQDAKSLAESLQVRKGQMEDWLKRAVQEGKVIKQKNPVMYVVNKEFNLLALLEKDDSG

SEQ ID NO: 8455 - protein, 457 aa, Nitrococcus mobilis Nb-231
MLTAHTQAVLLLTAHFPGTQAGDSSPLTNTEWAEFACWLKDHDQRPEDLLAADFAGYLDGWSHKKITLERLDSLLARGSALAMALEKWQRAGIWVITRSDINYPKLLKKKLGQKAPPVFFGSGNSRLLNQAGIAMVGSRRSTEQDLRYSRELGACCAGAAYAVVSGGAQGVDESAMLGALDVDGTAVGILAKELLRSANSTKYRRHLIAGNLALVSPFNPEASFNAGNAMQRNKYIYCMAQAAISVHSGTSGGTWNGVRENLKHGWVPMWIKPTQDPEAGNALLVKEGGHWLLDKPSEIDFAGLVQPASVPKPSGELMSLAQSAVPANGDRLEAANISLQAASELPENDALAVKCGASSQTQSATGAGLKVPDPWQWALEAASLPLYEYFLRILKYQAAAPKTIEELQVLPQLAKVHKAQLQAWVKKAAKDGHIDEVSLEGKTVCYQWNESRNLNLL

SEQ ID NO: 8456 - protein, 469 aa, Nitrosomonas europaea
MTSVLSPNTQAILLLTAPLIAGRGTASSDLLSPGEYKRLARHLREIQRQPADLLSPDAAEILRACQPVIDEGRLQKLLGRGFLLSQVIERWQARAIWVVSRADAEYPRRLKARLREDAPAVLYGCGDMALLETGGLAVVGSRHVDDALIDYTMTVGRLAARAGRTLVSGGAKGIDQAAMRGALEAGGKVCGVLSDSLEKTTMNREHRNLLLDGQLVLISPYDPSAGFNVGHAMQRNKLIYALADTSLVVSSDLNKGGTWAGAVEQLDKLKFVPVFIRSTGESSAGLDGLRKKGALAWPNPQDVDSFKDVFNVAMPTPTASPQVGFALFSNEEPTSVDAKPTVPVPPDTAPAPQAESEPSAPVDVVSDAQPPAPALEEQPSVTPEAIPPIDDAMESAQPESSPAEVLFAAVRAAIQQLLSAPMKDADVAAALDVSNAQAKAWLQRLVDEGVLEKQKKPAGYIVKQKRLFE

SEQ ID NO: 8457 - protein, 415 aa, Nostoc sp
MLNHVLPPDTQAILLLCASFGQSRQVEPQPLTLSEYNSLAEWLLQQEMRPAHLLESTVKEQLKQLHISKLDPERLLALLARGAMLSLAVEKWTSRGLWILGRSDAQYPKLLKQRLKHSAPAILYGVGKIELLSQGGLAIVGSRDVDEELLAYTRKVAETSALDGMQVISGAARGVDQEAMLSILNAGGTSVGVLADSLTKAAVNSKYRSSLKEGRLALISSYDPDAGFNTGNAMGRNKYIYALADYALVVNSSFGQGGTWAGAVEALSRLKEIPVFVRMAPTASEGNRQLHNQGAKPFPPEPWNGSLNKLLAKASSLVESIDTNIIQLPPEKSQDTQSHELSSTPQNIYEAVLPFILGHLQQPKDAKTLAQCLEVQPSQMQEWLKKAVQEGKVRKTNRPVAYIANQLVTQLSLLS

SEQ ID NO: 8458 - protein, 419 aa, Oscillochloris trichoides DG6
MTVTAHLLTPDTQAILLLTGSLGQVRGRDVQPLSASEYHQVAQILHRHQLRPADLLEGSGLSCLRDAEPLQFDSDRIARLLSRGAALGLIIETWTNRGLWVISRSDPQYPQRLRLRLGKSAPPILYGVGNQKLLDTGGLAIVGSREIDDAAVAFTRTLATRCARDAVQVVSGGARGVDSEAMMTALEAGGTAIGVLAESLVKAAVAGKYRSALRAGQITLITAYDPEAGFSVGNAMGRNKQIYALSDYALVVSASLEQGGTWSGAVENLAQQWVPLFVRATQPMLPGNQRLIERGGTAFTDLILASGTSIRLWLEQQIESHLEPITNKQLQSNDEPDQQTKPNNKESDLFLVIWPYLEEALQIERTDRELAAHFAIELTQVRAWLQRAIEDRMVKKLSKPVRYVAVHRTAQATMLPLFP

SEQ ID NO: 8459 - protein, 439 aa, Pelodictyon phaeoclathratiforme BU 1
MQQLSSNTKAILLLTAPLIAGHGSSSPDLLSPGEYNRLARYVHDIHHEPADLLLPGAENLHRSCQHIVEEKRMQTLLERGFLLSQVVEQWQARALWVVSRADAAYPRRMKARLREGAPAVLYGCGDIHLLETGGLAVVGSRQVDEELINYTMSIGQLSARAGRTIISGGAKGIDQAAMRGALEAGGKVCGVLADRLERTAMQRENRNLIVEGRLVLVSPYDPSAGFNVGNAMQRNKLIYALSDASLVVNSDSNKGGTWAGAIEQLEKLRLVPVYVRSTGSASTGIDALRDRGALPWPEPHDVEAFEAVLDTSPSLIPVEREASIGLFSNGMVQDSVTETAQKKPQVQIMEDISLPLHMSEEAELSPAQRLFATVREAIRQLLKKPMTDTEIAEILELSPLQTRVWLQRLVDEGLLEKKNKPVRYCIKESGFFENVPHAT

SEQ ID NO: 8460 - protein, 473 aa, Photorhabdus luminescens
MNLSPTAQATLLLTSYFSKASSDDVKPLTNAEWGRFALWLKEKSTTPADLLVSEPKSILSTWQDSRISTERIIQLLNRGHSLALAVEKWHRAGLWVVTRSDPEYPKRLKQQLKTDSPPVLFGCGNKALLNVGGLAVIGSREANNADLSYTELVGSRAASEGIAIVSGGARGVDETAMVGAMLGGGNVIGVLADSLLKAATSAKWRKGLMNGSVMLISPFYPEAGFSTGNAMARNKYIYCLADSSLVIHSGKKGGTLSGAEENLKKCWVPLWVKPTNDSSAANTDLVAKGGHWCEADVHNLKVSDLFSVENSTASQKEAEQVDLFFMPAQSELFAKPASEFDLEVAENRIIVAHSIEQDEIQGSIDHEAEAEAAAAAAEAEAEAEAEAEAEAEAEAEAEAEKTVMQAVDFYQLFITELHRLTVSPITLDTLIENTGLHKSQLKEWLKRAIDEGQVKKLGRPVRYQIEKKNQKVV

SEQ ID NO: 8461 - protein, 456 aa, Polaromonas naphthalenivorans CJ2
MPVLSPNTQAILLLTAPLIAGRGAPSSELLSPGEYKRFARHLWDMQRQPADLLLPDAPDLLRACAPVIEESRLQRLLGRGFLLSQAIERWQARAIWVVSRADANYPRRLKERLRENAPAILYGCGEIGLLDAGGLAVVGSRHVDEALIEYTMTVGRIAARARRTIVSGGAKGIDQAAMRGALEAGGKVCGVLADSLEKTVMNREHRNLLMEGQLVLVSPYDPSAGFNVGHAMQRNKLIYALADAALVVSSDLNKGGTWAGAVEQLDKLRLVPVYVRSTGEASEGLEALRKKGAVTWPDPLDADSFQTVFEAITPVSETQVSAELFSSGEPPVSAPAAMAVFPDAQPLLSAIAIAKDQSVTEVASQTLEAVPASEARQQSDKVIQVESSLGRALFSTVREVMQRLLITPMKEAEVGSALEVSTMQAKAWLQRLVDEGVLEKQKKPAAYKVKESRLFD

SEQ ID NO: 8462 - protein, 449 aa, Providencia stuartii ATCC 25827
MNVSSSLSPTAQATLLLTSYFSKASSEAVKPLTNTEWGRFALWLKEKSTTPADLLVSDPKALLSGWHDARISTERIVELLNRGHSLALAIEKWQRAGLWVVTRSDPEYPKRLKQRLKTDSPPVLFGCGNKALLNMGGLAVIGSRNASVSDLTYTDQIGAKAASDNVAIISGAARGVDETAMLGAMRQGGVIIGVVADNLLKAATSSKWRKGLMEGHAVLVSPFYPEAGFSTGNAMARNKYIYCLADSALVIHSGKKGGTLSGAEENLKKMWVPLWVKPTIDKSAANADLVAKGARWLTDDVQHSNIAELIRNDVNSVEQVKEEQPDLFSSAVPEQPELFAEPNPILEANLPEIENNVSSGVEQTDSLAVSKQSIEIEELRSTPVDFYQLFTMELQGLAKEPISLDELIAKTELHKSQLNEWLKRAEKDGLVKKLKRPVRYQAVIEKEQG

SEQ ID NO: 8463 - protein, 482 aa, Pseudomonas aeruginosa 39016
MAATQERQWRGLADGPLADGARRMTPVLSPNTQAILLLTAPLIAGRGTASPDLLSPGEYKRLARHLREIQHQPADLLSSGAAEILRACQPVIDESRLQRLLGRGFLLSQVIERWQARAIWVVSRADAEYPRRLKARLREDAPAVLYGCGDMGLLETGGLAVVGSRHVDDELIDYTMSVGRLAARANRALVSGGAKGIDQAAMRGALEAGGKVCGVLADSLEKTTMNREHRNLLLDGQLVLISPYDPSAGFNVGNAMQRNKLIYALADASLVVSSDLNKGGTWAGAIEQLDKLKFVPVFVRSTGESSAGLDALRKKGALPWPNPQDVDTFAEVFNVQMPTVTDSPQVGLSLLDGSPAAVTTAPIPPDAASLPTTESEPAVSNAQPSAATSDELPIATSEALAPAGETKESPQPESIPADVLFAAVRVAIQQLLNAPMKDAEVATALDVSNTQAKVWLQRLVDEGLIEKQKKPAGYILKQKRLL

SEQ ID NO: 8464 - protein, 455 aa, Pseudomonas syringae pv B728a
MINTNTQSILLLTSYFSKSVGGAKPLSPTEWGRFAQWLNAQGKTPADLVTAEPHAVLEGWHDEKIPLLRIEQLLERGHALALALEKWSRAGLWVLTRSDADYPKALKHHLRNSAPPILFGCGNPRLLNQRGIGVVGARKADDADLAYATSLGKRIAMAGMTVVSGGARGVDEAAMQGGLNEEGTVIGIMADSLLSAALASKWRNGLMSNNLVLVSPFFPEAGFNAGNAMARNKYIYCLSQAAVVVRSETRGGTWNGAIENLKKAWVPLWVKRDTNPESGNYALVSQGAQWLESAAKHVDVHTLSAQAKPESDPEMVPELAPTDQDASISEEDPVRSPPPRDEAPHQLSRDDGRSSQNANSASTHATTIGDLSFYQFFLRKMALRDSPGTAEELSEQWGISKKQLTEWLKQSVDERHVQKLKNPVRFQSLDVGKFEGSIGKNLDPSSDGQLGFKLD

SEQ ID NO: 8465 - protein, 439 aa, Roseiflexus castenholzii DSM 13941
MVEHELTPDTQAILLLCGTFGRRGSSVAPLSAAEYHALALWLHAQQMRPGDLLHPEGVACIQSMPGAPVVQERLLALLARGGALALTVEGWSNKGLWVMSRSDPDYPQRLRARLERIAPPLLYGAGNRRLLQNGGLAIVGSRRVTEDAIAFTCDIARRCAIQGIPVISGAARGVDSEAMQAALAADGAAVGVLADSLLRAAVSGKYRQALRNGNLALVTAYDPEAGFSVGNAMGRNKYIYTLSDYGLVVSASLGEGGTWDGAIECLKKQWVPLFVWSSDKAGPGNQRLCEMGAISLSQELLSKYASLHHLFNDLSRASVPTPLLRESEAINEHSARMSPGKGMNTTAGNERSVHDTSSLDQATLALMPVDTNGAAPAIDLFPIVWPHLVQALRVAQTEREIAQHCGIEPQQARAWLQRAVQEGLAVKLTRPIRYVLHKP

SEQ ID NO: 8466 - protein, 437 aa, Shewanella baltica OS155
MNLSPTAQATLLLTCYFSKASNENAKPLTNAEWGRFALWLKEKSTSPADLLGADPYALLSGWHDDRVSAERIMQLLNRGHSLALAVEKWQRAGLWVVTRSDPEYPKRLKQRLKTASPPVLFGCGNKALLNEGGLAVIGSRNASDDDLFFTQQVGAKAASEGVAIVSGGARGVDETAMLGAMQQGGFVIGIMADSLLKAATSAKWRKGLMDNNAVLISPFYPEAGFNAGNAMARNKYIYCLADSSLVIHSGKKGGTLNGAEENLKKAWVPLWIKPTTDKDAANADLVVKGGQWLETELQSLVVADLMKNEGNQMSPPKEIQADLFSMPAESGLFTEPEPEKVDSYTEHDIAHAEQQADKESLSAHIVEIEPASNPIDFYQLFIAELNRLAKDAVSVDELIEGTGLHKSQLNEWLKRAEEDGLVNKLNRPVRYQFENKK

SEQ ID NO: 8467 - protein, 349 aa, Shigella dysenteriae 1617
MPQPQEKLTGWSDPRISQERILGLLARGHSLALAVDKWQRAGLWILTRGDADYPVRLKNRLRTDAPPVLFGCGNKALLQAEGMAIVGSRDAPTDDLRYTQQLAAKLAQQGICVISGGARGIDECAMASALEAGGTAVGVLADSLLKTSTLVKWREGLIAGNLVLISPFYPEVRFTVGNAMARNKYIYCLAESAMVVRAGMTGGTITGAMEALKHQWLPVQVKPNQDMQSANSRLVENGASWSAEQAENVTIRLPDVPGLMYDRALRNAQPELFSLHEDDANYAVMPAYTPVDFYQLFVAELAILAKESIRIERLASCTGLTIEQISVWLNRAEEEGRVIRLGEGHYQFR

SEQ ID NO: 8468 - protein, 431 aa, Shigella dysenteriae
MDADSSDSTVTPGRLPDGLSSCPCFYLGKKLMNLSANAQATLLLTSDFSRAAASEYKPLSNSEWGKFALWLKHQRISPAELLVPQPQEKLTGWSDPRISQERILGLLARGHSLALAVDKWQRAGLWILTRGDADYPVRLKNRLRTDAPPVLFGCGNKALLQAEGMAIVGSRDAPTDDLRYTQQLAAKLAQQGICVISGGARGIDECAMASALEAGGTAVGVLADSLLKTSTLVKWREGLIAGNLVLISPFYPEVRFTVGNAMARNKYIYCLAESAMVVRAGMTGGTITGAMEALKHQWLPVQVKPNQDMQSANSRLVENGASWSAEQAENVTIRLPDVPGLMYDRALRNAQPELFSLHEDDANYAVMPAYTPVDFYQLFVAELAILAKESIRIERLASCTGLTIEQISVWLNRAEEEGRVIRLGEGHYQFR

SEQ ID NO: 8469 - protein, 462 aa, Teredinibacter turnerae T7901
MNVPHFSSADGALSAESSLSPTAQATLLLTSYFSKASSESAKPLTNAEWGRFALWLKEKSTTPADLLVTDPKALLQGWHDARIGAERIIALLNRGHSLALAMEKWQRAGLWVVTRSDPEYPKRLKQRLKTDSPPVLFGCGNKALLNAGGLAVIGSRNASEADLAFTEQVGAKAAKEGIAIVSGGARGVDETAMLGAMKQGGVVIGVMADSLLKSATSIKWRKGLMDDHAVLVSPFYPEAGFSAGNAMARNKYIYCLADSSLVIHSGKKGGTLSGAEENLKKAWVPLWVKQTTDKDAANADLVTKGGRWLEADTQAFRIAQLMCNDGGRANQVQEQMGDLFSTPAQPKFFAETESDPEIEPDHKKEVVESEIESAVNENQAYNVVNSEQTAESEAASSGSVDFYQLFVSELQYLAKKPVTAEALIESTQLHKSQLTEWLKRAEEEGLLGKLNRPVRYQVKNKK

SEQ ID NO: 8470 - protein, 515 aa, Trichodesmium erythraeum IMS101
MLNHVLSSDAQVTLLLCASFGQNRNIQPQPLTLIEYNIVANFLIKNQVRPGYLLSKNGLDILPKINDKKLNYERLVALLERGGILAITLEKWVNQGLWVLTRSDQNYPIKWKQNLQYLAPVIIYGVGNIELLEKGGLAIVGSRDINEEEVEYTKKVGKVCASEGINVISGGAKGIDQEAMLGTLEFGGTAVGVLANSLNKASVSRKYRDSIRADKLTLISTYDPDAGFSVGNAMGRNKYIYALSDYALVVSSSFNKGGTWAGATEVLKKYKKIPVFVKVQGKVKEGNKALLDKGARSFPFDPWDGNLKDFLVGSKCDLKLSENISLIELETPVNISAKTANLNVETKSNLSIYEGTNPSIYEKVLPIILKNLIRPQKAKSLSKILDVRVGQLRNWLSQACDEEKIVKDEKTAIYRIVAETKQYQNYQISTEELNVYEMVLPILLDNLNKPQKIQDLAKILNVNKSQLEDWLKIAKTEGKIMLEKNSNVYVIYQDIKQLSLFDRVEDEDDEEGLDW

SEQ ID NO: 8471 - protein, 442 aa, Vibrio furnissii CIP 102972
MNLSPIAQATLLLTSYFSKANTEDVKPLSNAEWGRFALWLKDKSITPADLLVSDPRPLLNGWRDTRVSIERIESLLSRGHSLALAVEKWQRAGLWLVTRSDPDYPKRLKLRLKNDSPPVLFGCGNKSLLNFGGLAVIGSRNASVADLAFTEQLGVKAASEGIAIVSGGARGVDEAAMQGAMLRGGSVIGVMADSLLKAATSAKWRKGLLENNVVLVSPFYPEAGFNAGNAMARNKYIYCMASSSLVIHSGKKGGTLNGAEENLKKGWVPLWVKPTNDTNAANADLVEKGGAWIESDLSMLQIASMLQPNKQNSLVSTPTQHNLFTTPDLPGKFDELETEEKTENETASNSMMDVNNDEVAQTSEKEQSEDVNESIAPHPVDFYNIFLGELYRLASSPITLEELIEQTELHKSQLNDWLKRASEECVVKKLSKPVRYQVINNN

SEQ ID NO: 8472 - protein, 400 aa, Escherichia coli E22 (EPEC); identical to SEQ ID NO: 8435

SEQ ID NO: 8473 - protein, 400 aa, Escherichia coli M605
MNLSANAQATLLLTSDFSRAAASEYKPLSNSEWGKFALWLKHQRISPAELLVPQPQEKLTGWSDPRISQERILGLLARGHSLALAVDKWQRAGLWILTRGDADYPVRLKNRLRTDAPPVLFGCGNKALLQAEGMAIVGSRDAPTDDLRYTQQLAAKLAQQGICVISGGARGIDECAMASALEVGGTAVGVLADSLLKTSTLVKWREGLMAGNLVLISPFYPEVRFTVGNAMARNKYIYCLAESAMVVRAGMTGGTITGAMEALKHQWLPMQVKPNQDMQSANSRLVENGASWSAEQAENVTIRLPDVPGLMYDRALRNAQPELFSLHEDDANYAVMPAHTPVDFYQLFVAELAILAKESISIERLASCTGLTIEQISVWLNRAEEEGRVIRLGEGHYQFR

SEQ ID NO: 8474 - protein, 400 aa, Escherichia coli M718
MNLSANAQATLLLTSDFSRAAASEYKPLSNSEWGKFALWLKHQRISPAELLVPQPQEKLTGWSDPRISQERILGLLARGHSLALAVDKWQRAGLWILTRGDADYPVRLKNRLRTDAPPVLFGCGNKALLQAEGMAIVGSRDAPTDDLRYTQQLAAKLAQQGICVISGGARGIDECAMASALEAGGTAVGVLADSLLKTSTLVKWREGLIAGNLVLISPFYPEVRFTVGNAMARNKYIYCLAESAMVVRAGMTGGTITGAMEALKHQWLPVQVKPNQDKQSANSRLVENGASWSAEQAENVTIRLPDVPGLMYDRALRNAQPELFSLHEDDANYAVMPAYTPVDFYQLFVAELAILAKESISIERLASCTGLTIEQISVWLNRAEEEGRVIRLGEGHYQFR

SEQ ID NO: 8475 - protein, 400 aa, Escherichia coli O111:NM B171 (EPEC2); identical to SEQ ID NO: 8435

SEQ ID NO: 8476 - protein, 400 aa, Escherichia coli O139:H28 F11 (ETEC); identical to SEQ ID NO: 8431

SEQ ID NO: 8477 - protein, 431 aa, Escherichia coli O157:H7 EC4042; identical to SEQ ID NO: 8437

SEQ ID NO: 8478 - protein, 431 aa, Escherichia coli O157:H7 EC4045; identical to SEQ ID NO: 8437

SEQ ID NO: 8479 - protein, 431 aa, Escherichia coli O157:H7 EC4206; identical to SEQ ID NO: 8437

SEQ ID NO: 8480 - protein, 353 aa, Acidovorax avenae citrulli AAC00-1
MIELTSGDILKDDSDAIVNTVNCVGIMGRGIALQFKNAWPENFKAYKAACDREEVQPGRMFIYDTEQLAAPRYIVNFPTKRHWKGKSRMQDIDAGLEALVRDVARLGIRSIAIPPLGSGLGGLEWDEVRPRIEAAMQALPDVRVRIYEPKGAPAADKMQHSREVPRMTAGRAALVELMNRYVQGLLDPTISLLEVHKLMYFMQEAGEPLRLSYVKAPYGPYAENLRHVLQKIEGHMVAGYADGGDDPTKPLTVVPGAVEEAGAFLGEHVDTRARFDRVGDLVEGFETPFGLELLATVHWVASHTVAGGGVEDVVRETHAWNDRKKQFTPRQIGIALNVLDAKGWLPAAEQVGA

SEQ ID NO: 8481 - protein, 288 aa, Actinosynnema mirum DSM 43827
VIKNGVGDLLTADVEALVNTVNYVGVMGKGLVLQFKRRYPESFESYARVCKDGAVKLGRMHVVELNAITGPEYVVNFPTKGHWKANSKLSDIETGLDDLVRVIKERSIKSIAIPPLGAGNGGLPWSDVEPLIRAKLAELPEVSVLLFTPSNADRHLTPEPVKMTGRSTLVELLPAHTVQRQAAEPQEDRTGASHWELQKLMHFAQLTTPELKLEFAQGYYGPYSEKVRHLIQGMEGTFVEGCGDGSKPVRELTPIHPAETGKDRELIEGLEGAHSIELLASTHWVAQR

SEQ ID NO: 8482 - protein, 341 aa, Aliivibrio salmonicida LFI1238
MIVYVKGDLLNDDAEALVNAVNTVGVMGKGLAYQFKEKFHENFLIYRDVCKKELLSVGKVLLVETDEGSIPNYIINFPTKAHWRGKSKIEYIEEGLNDLIKVVKENQINSVALPALGSGLGGLPWSQVERVMLDKLSNIENIEWRIYAPNNTPNLRKKLPLTEGRSILIYTLNYYLRMTKKQQLTELEIHCLMYLLQCNGLSLTGIKFNEFREVPFSDVLHVALSKMDGDFLYISGVNKPIQSSFITLESKIVVEAKKLLQKKVEKIKKISDVMELISGYESKDGMAIISTALWVANENKNANVDLANTTLDIISNNFNSSNGVVKGAFVRLYEEKWLPLN

SEQ ID NO: 8483 - protein, 362 aa, Alkalilimnicola ehrlichei MLHE-1
MIEYTRGNLLDADVEALVNTVNTVGVMGKGVALMFKEAFPENFRAYQAACKNREVVPGRMFVHERSALLGPRWIINFPTKQHWRGKTRMEWIDSGLRDLERVIRVNGIRSIALPPLGCGNGGLPWAQVRPRIESALRDLQDVRVVVFEPTRQYQNVAKRSGVEKLTPARALIAELVRRYWVLGMECSLLEVQKLAWLIERRIIDHGLENPLDLQFKALRYGPYSDRLRHLLNGLDGSYLRSDKRINDAGPEEVVWFDEARRDKLGIYLRSAEVRPYLGVLQEVDDLIDGFQSPLGLEVLATLDWLIWQEGVAPTIADVKEGLRRWPDDIAGQRKLRLFSDQLIELALARLTSRTPDLQVIAT

SEQ ID NO: 8484 - protein, 351 aa, Arthrospira maxima CS-328
MIHFKQGNLLTEKADALVNTVNCVGVMGKGIALQFKQAFPENFRAYKTACDAKRIHPGQMFVVATDKLFPKYIINFPTKRHWKGKSKIEDIKAGLIALVEEVKRLEITSIAIPPLGCGNGGLDWAAVKPLIVQSFAEVPDIEVMIFEPTGAPVADQIPVATSTPKMTIGRALLIRLLELYGIPGYRLTKLEIQKLAYFLQVAGEPLRLRYVKHQFGPYADNLNHVLQKIEGHYIRGYGDRTETSAMYVLEKGRDAADRFLSAHPDTGARRQRVSDLIEGFETPYGLEMLATLHWVATEDPQAAIDCDRAIEKVQEWSDRKRHLFKPNHLRIAWERLHTQNWFNINSDAETP

SEQ ID NO: 8485 - protein, 351 aa, Arthrospira maxima CS-328
MIHFKQGNLLTEKADALVNTVNCVGVMGKGIALQFKQAFPENFRAYKTACDAKRIHPGQMFVVATDKLFPKYIINFPTKRHWKGKSKIEDIKAGLIALVEEVKRLEITSIAIPPLGCGNGGLDWAAVKPLIVQSFAEVPDIEVMIFEPTGAPVADQIPVATSTPKMTIGRALLIRLLELYGIPGYRLTKLEIQKLAYFLQVAGEPLRLRYVKHQFGPYADNLNHVLQKIEGHYIRGYGDRTETSAMYVLEKGRDAADRFLSAHPDTGARRQRVSDLIEGFETPYGLEMLATLHWVATEDPQAAIDCDRAIEKVQEWSDRKRHLFKPNHLRIAWERLDTQNWFDINSDDEIQ

SEQ ID NO: 8486 - protein, 141 aa, Arthrospira platensis NIES-39
MIQFKQGNLLTETTEALVNTVNCVGVMGKGIALQFKQAFPENFRAYKTACDAKKIHPGQMFVVATHELFPKYIINFPTKRHWKGKSKIEDIESGLIALVEEVKRLEIRAYRDSSSGMRKWGLRLDGSQASHRSSFCGSSGY

SEQ ID NO: 8487 - protein, 141 aa, Arthrospira platensis Paraca; identical to SEQ ID NO: 8486

SEQ ID NO: 8488 - protein, 359 aa, Aurantimonas manganoxydans SI85-9A1
MIRFVSGNLLNSGAEALVNTVNTVGVMGKGIALMFKEAFPANFRAYAAACKNEEIKVGQIFVTERTDWVGGPRWIVNFPTKKHWRNPSKIEWIDQGLEDLKRFVIANGVRSIALPPLGSGNGGLDWREVRPRIEQALGDLIDVDVIVYEPTDVYQNVAKREGVEKLTPARALVAELVRRYWILGIECTMLEIQKLTYLLDRNVKATGVDSPLKLAYKAERYGPYAQNLQHLLNSLDGSYLHCERRIADAGPLDIVWFEDSKRDHVAAYLKSADARPYLAALHATSDTIDGFESPLGMELLGTIDWLLDHGAEANVPAVREGLRNWAGGIEAGERKQRLFDDRMLQLALERLTGRIAEEA

SEQ ID NO: 8489 - protein, 341 aa, Bacillus thuringiensis IBL200
MIKLTTGNLLEADAQALVNTVNTVGVMGKGIALQFKQAFPDNFKAYQKACKINQVQPGKMFIYKTHLLGSPEYIINFPTKRHWKNKSRIEDIKSGLISLRNEIINYNIKSIALPPLGCGNGGLDWSEVKPLIIKSLEDLNATIYLYEPSGHPDPNSMKIGTTKPKMTKARALLLLLMEQYRAPGYHLSLLEIQKLAYFLQECGEPLRLNFVKYIYGPYAENLNHVLIRLEGHYIRGYGDRNSKSDINLFEDAILEAKEFISHDKESLTRLEEVKNLIEGFETPYGIELLATVHWSIKYGNNSIMDFEEIINYIQSWNERKKHVFKNNHIKKTMQHLEIFMQ

SEQ ID NO: 8490 - protein, 343 aa, Beggiatoa sp. PS
MIEYTSGDILRADAQAIVNTVNCVGVMGRGIALQFKKAWPDNFKVYAEACKNKQIQPGKMFVFDTQRLTNPHYIINFPTKRHWRDASRMEDIESGLEALIETIRENQIQSIAIPPLGCGLGGLDWEQVKSRIEPALSALPEVHVIVLEPKGAPENDKMVRNQPVPKMTAGRAVLIELIQRYLGGLLDPTVSLLEVHKLLYFMQEAGEPLRLKYKKAHYGPYAENLRHVLNAIEGHFILGYADGGDTPEKPLQLVPYAIDKANVYLNKHQETRERFSKVSDLVEGFESPFGLELLSSVHWLIKYEKLNRLEEVVQATHAWNERKQQFSLRQIKLALTCYIVKIG

SEQ ID NO: 8491 - protein, 349 aa, Brachyspira hyodysenteriae WA1
MIIYKTGNILETDSQCIVNTVNCEGYMGKGLAYQFKKAYPENEKAYIKACKTGQLAIGKVFLFEEDGKIIANFPTKDKWRLPSKMEYIKLGLSDLINKIIVKQIYSIAIPPLGSGNGGLNWEDVRKEIESSFYDLSEEIEVIVYEPAGNIQTNLKPKKAPKLSLSHYVVSKIESLLKYYNVKDKTYIRLQKSCYFFNHFYGKDYFDFKAYKYGPYSHDIEIVNKKINEYTLYYDIKDYNVLCNEIYKTIISKKIENELNNIENAIKLSSEYVNNIESNSELECLTTIMVLIKDYNYTIEEDIINGFKNWEFSKEKSRKFKEKDILNSINYLLNTNIISKGLLGYCLISN

SEQ ID NO: 8492 - protein, 353 aa, Candidatus Accumulibacter phosphatis clade IIA UW 1
MIEYASGDILKCATDALVNTVNCVGVMGRGIALQFKHAYPENFRAYAAACRRGEVQPGRMFVFETGQLTAPCYIINFPTKRHWRGKSRIEDIEAGLVALVEVIRARRIRSIAIPPLGSGLGGLDWVEVRPRIEAALAGLADVRVMILEPRGAPTSEAMVHSREVPGMTAGRAALVELMHRYLGGLLDPFVTLLEVHKLMYFMQEAGEPLKLKYVKAPYGPYAENLRHVLHLIEGHLIAGYADGGDAPDKPLTLVPGAVEDASSFLAQHPETRERFNRVAALVDGFESSFGLELLSTVHWVMKHESVTTLDDLVEAVYAWNSRKRRFTRRQIGIAAGVLAKTGWTPPVDAQVCA

SEQ ID NO: 8493 - protein, 349 aa, Cyanothece sp. PCC 7822
MIEFKQGNLLEADTEALVNTVNTVGVMGKGIALQFKQAYPENFRAYKKACDAQQVKPGQMFIFVANSLFNPKYIINFPTKTHWRGKSKLEDIETGLKALIEEVKQLEIKSIAVPPLGCGNGGLDWAEVKPMIVGAFAQLPEVKVIIFEPIGTPVSDKMQVNTAKPEMTRARALLIRLLELYNIPGYSLTKLEIQKLAYFLQEAGEPLKLRYVKDQFGPYADNLNHVLQRLDGHYIRGYGDRSQKSQMYVLPEGSEAAHQFLEQDPDANIRLERVSNLIFGFETPYGMEMLATVHWVAIQEDTQAAIDPECAICRVQQWSERKRNIFKPNHLRKAWERLHQQNWLSNSND

SEQ ID NO: 8494 - protein, 348 aa, Dermacoccus sp. Ellin185
MITDASGDLLKAPVDALVNTVNTVGVMGKGIALQFKRAFPQMYAAYRADADRGLIMPGRMHVWDTGQMLPPRYIINFPTKRHWKTPSRLDDIEAGLQDLVRVVQEREIGSLAVPPLGCGNGGLDWAVVRPLIVEAFAAAPGVDVRLFAPEGPPAAATMVARAARPQMTPGRAALVEMVRAYTGQAFSAPGLIEVQKLMYFLQEDGQPLQLRFKAHHYGPYADNLRHVLSLVEGHFLMGFGDGSARVQQSEPLRVVEGAAAEAENVLAGSEYLSSIERVLATVEGFESPYGLELLATTHWLMTREHATSVGDLVSHVAAWSDRKRRMFSDQDLAAARTHLVERGWAQAA

SEQ ID NO: 8495 - protein, 346 aa, Desulfovibrio sp. 3 1 syn3
MLKYTNGDIFASDAMALVNTVNTEGIMGKGLALQFKRRFPENFLAYAAACKRNEVKIGKMFIVPYNGLEGLKYLINFPTKVSWRNKSKIEDIVSGLQALKKEIVSLGITSVAIPPLGCGLGGLSWNIVKREIDMTFSDFDAADIIVFAPLKGKNPSPVVSTRTKMTNAKALFLRCFEKYMNLVPSVEITFVEAHKLGYLLQCACGADLRLDFKAWKYGPWARNMGHILGDMEGIWIDGFGDGTRKAFETFSLLPAAKVAKNTVLPDNYEAALEKIDKIFMGFENPLGLELLATVHWLIVHDHVEPEQEKIIDALAKWKDNQEGWGDRKLKYFPPRLIELALKRVSQ

SEQ ID NO: 8496 - protein, 349 aa, Dickeya zeae Ech1591
MIEYRQGDILQAETEAIINTVNCVGVMGRGIALQFKNAYPDNFKAYAASCKAKQVVPGKMFVFETGQLTNPRYIINFPTKRHWKGKSRLEDIAAGLDDLVAVIRQHDIRSIAIPPLGSGLGGLDWQDVKPLIESAVQPLESVQIAIYDPNGAPSSERMVHKTEVPKMTAGRAALVELMQRYLNGLLDPFISLLELHKLMYFMQESGEPLRLKYQKAHYGPYAENLRHVLNAIEGHMISGYSDGGDMPDKQLSLVPGVAEEAKAFLEQQEETYRRFQKVSDLVEGFESPFGLELLSTVHWTMQHESLTSPEDVTDFIYAWNERKRQFTPRQISLAVDTLHRKGWLTSTAA

SEQ ID NO: 8497 - protein, 355 aa, Edwardsiella ictaluri 93 146
MITYTQGNLLDAPVEALVNTVNTVGVMGKGIALMFKERFPDNMKAYADACKQKQVMTGKMFITETGELMGPRWIVNFPTKQHWRADSRMAWIEDGLQDLRRFLIEENVQSIAIPPLGAGNGGLNWPDVRARIESALGDLQDTEILIYEPTEKYQNVAKSSGVKKLTPARAMIAELVRRYWVLGMECSLLEIQKLAWLLQRAIEQHQQEDVLKLRFEAHYYGPYAPNLNHLLNALDGTYLKAEKRIPDSQPLDVIWFNDREKEHINLWLNSEAKAWLPALEQVSQLIDGFESPFGLELLATVDWLLTRGQCQPTLDSVKEGLHQWPAGEPWASRKIKLFDDKNLQFAINRVMEFHC

SEQ ID NO: 8498 - protein, 355 aa, Edwardsiella tarda EIB202
MITYTQGNLLDAPVEALVNTVNTVGVMGKGIALMFKERFPDNMKAYAHACKQKQVMTGKMFITETGELMGPRWIVNFPTKQHWRADSRMAWIEDGLQDLRRFLIEKKVRSIAIPPLGAGNGGLNWPDVRARIESTLGDLQDTEILIYEPTEKYQNVAKSSGVKKLTPARAMIAELVRRYWVLGMECSLLEIQKLAWLLQRAIEQHQQEDVLKLRFEAHYYGPYAPNLNHLLNALDGTYLKAEKRIPDSQPLDVIWFNDREKEHINLWLNSEAKAWLPALEQVSQLIDGFESPFGLELLATVDWLLTRGQCQPTLDSVKEGLHQWPAGEPWASRKIKLFDDKNLQFAINRVMEFHC

SEQ ID NO: 8499 - protein, 338 aa, Edwardsiella tarda FL6-60
MNTVNTVGVMGKGIALMFKERFPDNMKAYAHACKQKQVMTGKMFITETGELMGPRWIVNFPTKQHWRADSRMAWIEDGLQDLRRFLIEKKVRSIAIPPLGAGNGGLNWPDVRARIESALGDLQDTEILIYEPTEKYQNVAKSSGVKKLTPARAMIAELVRRYWVLGMECSLLEIQKLAWLLQRAIELHQQEDVLKLRFEAHYYGPYAPNLNHLLNALDGTYLKAEKRIPDSQPLDVIWFNDREKEHINLWLNSEAKAWLPALEQVSQLIDGFESPFGLELLATVDWLLTRGQCQPTLDSVKEGLHQWPAGEPWASRKIKLFDDKNLQFAINRVMEFHC

SEQ ID NO: 8500 - protein, 361 aa, Enhydrobacter aerosaccus SK60
MITYTQGNLLEADTQVLVNTVNTVGVMGKGIALMFKQQFPENFKRYAKACKSGDVQVGKMFVVDIDTPPTQHSQPQLKQRWIVNFPTKQHWRAKSQIEWIQAGLQDLRQWLIDNRIESIAIPPLGAGNGGLPWQQVKPLIEQALGDLPNIDIQIFEPSDSYYSVATATTTDTLTHARALLYQVVDRYWVLGMECSLLEVHKLMWFLQRAIERHRLANPLQLSFMPHYYGTYAPNLRHLLNNLDGSYLLAEKRLPDCKPLDVIWTNQTKQAEVEQYLQTSMSDFLPVLTEVDNVIAGFESPFGLELLSTVDWLIYQEQYPATAEGIKQGMANWQAGEIWAKRKLELFNDQHIDIALQHLKTI

SEQ ID NO: 8501 - protein, 342 aa, Escherichia coli 0127 H6 E2348 69
MEALVNTVNTVGVMGKGIALMFKERFPENMKVYALACKQKQVITGKMFITETGELMGPRWIVNFPTKQHWRADSRMEWIEDGLQDLRRFLIEENVQSIAIPPLGAGNGGLNWPDVRAQIESALGDLQDVDILIYQPTEKYQNVAKSTGVKKLTPARAAIAELVRRYWVLGMECSLLEIQKLAWLLQRAIEQHQQDDILKLRFEAHYYGPYAPNLNHLLNALDGTYLKAEKRIPDSQPLDVIWFNDQKKEHVNAYLNNEAREWLPALEQVSQLIDGFESPFGLELLATVDWLLSRGECQPTLDSVKEGLHQWPAGERWASRKLRLFDNNNLQFAINRVMEFHC

SEQ ID NO: 8502 - protein, 355 aa, Escherichia sp. 4 1 40B
MITYTQGNLLDAPVEALVNTVNTVGVMGKGIALMFKERFPENMKVYALACKQKQVITGKMFITETGELMGPRWIVNFPTKQHWRADSRMEWIEDGLQDLRRFLIEENVQSIAIPPLGAGNGGLNWPDVRAQIESALGDLQDVDILIYQPTEKYQNVAKSTGVKKLTPARAAIAELVRRYWVLGMECSLLEIQKLAWLLQRAIEQHQQDDILKLRFEAHYYGPYAPNLNHLLNALDGTYLKAEKRIPDSQPLDAIWFNDQKKEHVNAYLNNEAREWLPALEQVSQLIDGFESPFGLELLATVDWLLSRGECQPTLDSVKEGLHQWPAGERWASRKLRLFDNNNLQFAINRVMEFHC

SEQ ID NO: 8503 - protein, 365 aa, Eubacterium saburreum DSM 3986
MEVKIGDIFESKCSVIVNTVNCVGVMGKGIAKEFKKRYPDMFSDYVKRCNLGQVRTGKPYVFEEKSGIKILNFPTKEHWRSPSKLSYIVDGLDWFVQNYNRLNISSIAFPPLGCGNGGLDWDVVGPIMYHKLKNLPIEIEIYAPFGINRNETIKDFLSQRVVEEDFTGVSNLKINHKWFLILEAIKEINSNRYSLKVGRTIYQKICYVITRNGVNTGFKFTKGSYGPYSVDAKNSIIRLANSNLITERVCGRMVLLKVADEILVDKDDFSDKEWNAMKKTVDLFGRVKSTEQAEIMSTVLFSYDKLSDAKSKISDKDVYDYVMSWKPHWEKEKSYEVSDTIHNLAMLAFISIEHSNLLLYPTISR

SEQ ID NO: 8504 - protein, 351 aa, Geobacter lovleyi SZ
MIEYKTGNILAEDVEAVVNTVNCVGIMGRGIALQFKNTYPDNFKAYAAACKLNEVQPGRMFVYETGRLTNPRFVINFPTKRHWKAKSRIEDIDAGLVALVEEIRIRKISSIAIPPLGAGLGGLDWKQVRPRIEAALQGVEGLRVVIFEPAPDKADERANRSSDVPKMTPGRAALVGLMHRYLAGLLDPFITLLEVHKLMYFMQAAQEPLRLNYTKAPYGPYAENLRHVLRAVEGHLVSGYADGGDAPDKQLELVPGALVDAQTFLQEQPDTVNRMNRVFELVEGFETPFGLELLATVHWVVSQEQACSLEEVTARVYGWNDRKRQFTPRQIALAVFMLSKKGWIPSLAGSA

SEQ ID NO: 8505 - protein, 345 aa, Gloeobacter violaceus
MVELTKGDILSADAEALINTVNCVGVMGRGVALQFRKAYPENFKAYESACKRKEVRLGEVFVHDLHSFINPRYIINFPTKDHWKGSSRLSYIESGLRSLIGEVEKLGIRSLALPPLGCGLGGLDWREVRPLIEAAFAQVPWVHVLLFEPVGAPSPATMPKSNKKPSMSPGKAVLLGLMDRYLAALMDPFVTLLELHKLMYFMQEAGEALRLNYTKGTYGPYAENLRHVLNAIDGHYISGYGDGEDSPTKQIEPNAEAVGMALAFLEECPQTRERFERVIDLIEGFETSYGMELLSTVHWVAKTEGAGTPEKAVQFTHAWNDRKRTFEPRHIRVAWDILDDKGWLF

SEQ ID NO: 8506 - protein, 351 aa, Gluconacetobacter diazotrophicus PAl 5, DSM 5601
MTIEYKSGDMFDEPAEAIVNTVNCVGVMGKGVALEFKRRWPDNFRAYKRLCDAGKLSPGEMFIFQIGDLLQKGDRQFLINFPTKQHWKAKSKIEYVEHGLENFMHQVRELGIKSVVMPPLGCGNGGLDWNEVRPLIEEKLSSLPDVKFIVFAPSTGVCQVTEQENVPSGLTIPRATMMVALGELEKYFGGHFTRLTAQKLVYFMQVLGSDFGLTYSKAKFGPYSEQLHGIFKVMERKQYISGYEGDDHEVVVTPSTFAASDDFLKSNEVDVSPLVQKLSLLVEGYESPYGMELLSSVHYLAITEGITTQPEMSEALESWNDHKRESFPRTAVTTALGRLIEDECLEIVANV

SEQ ID NO: 8507 - protein, 355 aa, Klebsiella pneumoniae 342
MMTYTQGNLLDAPVEALVNTVNTVGVMGKGIALMFKERFPDNMKAYALACKQKQVMTGKMFITETGELMGPRWIVNFPTKQHWRADSRMEWIEDGLQDLRRFLIEENVRSIAIPPLGAGNGGLNWPDVRTRIESALGDLQDTEILIYEPTEKYQNVAKSTGVKKLTPARAMIAELVRRYWVLGMECSLLEIQKLAWLLQRAIEQHQQEDVLKLRFEAHYYGPYAPNLNHLLNALDGTYLKAEKRIPDSQPLDVIWFNDREKEHVNLWLNSEAKEWLPALEQVSQLIDGFESPFGLELLATVDWLLTRGECQPTLDSVKEGLHQWPAGERWANRKMKLFDDKNLQFAINRVMEFHC

SEQ ID NO: 8508 - protein, 343 aa, Leptotrichia goodfellowii F0264
MEIRQGNIFESETQALINPVNTQGIMGKGLAYQFKIKYPNNFQNYEQKCLIKEVDVGKDLIYTEEKDKIIINFPTKKNWKEKSKIEYIEIGLKKLEELLEKLRIKSVSIPPIGAGNGKLDWKLVKNEIEKFEKRVSKSTNVIIYEPAISESKLSKGHYLIAYTLVKAEEKGIKKEITDLVLQKLIYLGDRNNYFKFKEESEGPFSKLISIQYQKLKEYSKLNNKKLVEIEKELLKEEITKNLQKEKENIENAIQIYINMKNFYSISVKEEIENKVELLSTVIYILKNKKDDEISNNNIYEEMKSWNKRKDKKYSLEDIGQMFDFLEKEKILKKDIFNKYIMKY

SEQ ID NO: 8509 - protein, 354 aa, Lyngbya sp. CCY 8106
MIEFKEGNLIKENIEALVNTVNCVGVMGKGIALQFKQAFPENFKQYKKGCEAKEIQPGKMFTTSTGKLFPRYIINFPTKRHWKGKSKIEDIASGLKALVEEVQQLKIKSIAIPPLGCGNGGLDWVQVKPMIVNAFAEFTDVKIVIFEPGSAPVADKIQVATKKTKMTLARALFIRLLELYAIPGYQLTKLEIQKLAYFLQEAQEPLKLNYEKHLYGPYADNLNHVLQALDGHFIRGYGDRSQRSQMYVLPEGSKAAHSYLEKHPEANNRLAKVSNLITGFETPYGMEMLATIHWVVTREDPQAAEDCERAIALVQQWNERKRKLFKPSHLRKAWERLQQQNWFLDVSTNNKQQQ

SEQ ID NO: 8510 - protein, 347 aa, Marinobacter sp. ELB17
MIEYKTGDILREDADAIINTVNCVGVMGRGIALQFKKAFPDNFKAYAAACKNRQVEPGRMFVFETGQLTAPRYIVNFPTKRHWRGASRLEDIDAGLKALVDTIHQYQIQSIAIPPLGSGLGGLDWSEVKPRIESALRPLGDVRVIVYEPKGAPPAQKMVQNRKVPEMTAGRAALVELVNRYLGGLLDPSVTLLEVHKLMYFMQEAGEPLRLKYQKAGYGPYAENLRHVLNAVEGHLLSGYADGGDAPDKPLQLVPGAVDDASRFLLQHPDTLSRFDKVAQLVEGFESPFGLELLSTVHWVIKKESASTREQAIRQVYDWNDRKHQFSERQIELAARVLETKGWTEAV

SEQ ID NO: 8511 - protein, 384 aa, Micromonospora aurantiaca ATCC 27029
MSSLPSKDGDLVQLKRGDLLNSKAHALVNTVNCVGIMGKGIALAFKKRYPNMFRDYVRRCDQGLVQLGKPYAYQDEEKLIINFPTKQHWRSVSRLEDIEHGLEHLRSNLSKWGVRSIAVPPLGCGNGQLEWSVVGPTLYRHLSTFGIPVELYVPHDVEPDQAQLALFNPQASPPSGVASAHEARYVDPATIALVEILHRIEQEPFHWPVGRIMFQKLAYFATAAGLPTGLDYQAASYGPYAADLKRVVGRLQNNGLVKEQQNGRAFEVKVGPTFTDARASAIGELDGWEDRISRVVDLISRFNPSRAEVAASVHYAADALRNKLGRTPTAEEVVDAVLKWKVRRQPPIRREDVEQAVVQLAIQRWIEVEPDDSIADAANELVGV

SEQ ID NO: 8512 - protein, 352 aa, Mycobacterium bovis
MITYGSGDLLRADTEALVNTVNCVGVMGKGIALQFKRRYPEMFTAYEKACKRGEVTIGKMFVVDTGQLDGPKHIINFPTKKHWRAPSKLAYIDAGLIDLIRVIRELNIASVAVPPLGVGNGGLDWEDVEQRLVSAFQQLPDVDAVIYPPSGGSRAIEGVEGLRMTWGRAVILEAMRRYLQQRRAMEPWEDPAGISHLEIQKLMYFANEADPDLALDFTPGRYGPYSERVRHLLQGMEGAFTVGLGDGTARVLANQPISLTTKGTDAITDYLATDAAADRVSAAVDTVLRVIEGFEGPYGVELLASTHWVATREGAKEPATAAAAVRKWTKRKGRIYSDDRIGVALDRILMTA

SEQ ID NO: 8513 - protein, 352 aa, Mycobacterium bovis BCG Pasteur 1173P2; identical to SEQ ID NO: 8512

SEQ ID NO: 8514 - protein, 352 aa, Mycobacterium bovis BCG Tokyo 172; identical to SEQ ID NO: 8512

SEQ ID NO: 8515 - protein, 352 aa, Mycobacterium tuberculosis 210; identical to SEQ ID NO: 8512

SEQ ID NO: 8516 - protein, 352 aa, Mycobacterium tuberculosis 98-R604 INH-RIF-EM; identical to SEQ ID NO: 8512

SEQ ID NO: 8517 - protein, 352 aa, Mycobacterium tuberculosis CDC1551; identical to SEQ ID NO: 8512

SEQ ID NO: 8518 - protein, 352 aa, Mycobacterium tuberculosis F11; identical to SEQ ID NO: 8512

SEQ ID NO: 8519 - protein, 352 aa, Mycobacterium tuberculosis H37Ra; identical to SEQ ID NO: 8512

SEQ ID NO: 8520 - protein, 352 aa, Mycobacterium tuberculosis H37Rv; identical to SEQ ID NO: 8512

SEQ ID NO: 8521 - protein, 352 aa, Mycobacterium tuberculosis KZN 1435; identical to SEQ ID NO: 8512

SEQ ID NO: 8522 - protein, 352 aa, Mycobacterium tuberculosis KZN 4207; identical to SEQ ID NO: 8512

SEQ ID NO: 8523 - protein, 352 aa, Mycobacterium tuberculosis KZN R506; identical to SEQ ID NO: 8512

SEQ ID NO: 8524 - protein, 352 aa, Mycobacterium tuberculosis KZN V2475; identical to SEQ ID NO: 8512

SEQ ID NO: 8525 - protein, 352 aa, Mycobacterium tuberculosis SUMu001; identical to SEQ ID NO: 8512

SEQ ID NO: 8526 - protein, 352 aa, Mycobacterium tuberculosis SUMu002; identical to SEQ ID NO: 8512

SEQ ID NO: 8527 - protein, 352 aa, Mycobacterium tuberculosis SUMu003; identical to SEQ ID NO: 8512

SEQ ID NO: 8528 - protein, 352 aa, Mycobacterium tuberculosis SUMu004; identical to SEQ ID NO: 8512

SEQ ID NO: 8529 - protein, 352 aa, Mycobacterium tuberculosis SUMu005; identical to SEQ ID NO: 8512

SEQ ID NO: 8530 - protein, 352 aa, Mycobacterium tuberculosis SUMu006
MITYGSGDLLRADTEALVNTVNCVGVMGKGIALQFKRRYPEMFTAYEKACKRGEVTIGKMFVVDTGQLDGPKHIINFPTKKHWRAPSKLAYIDAGLIDLIRVIRELNIASVAVPPLGVGNGGLDWEDVEQRLVSAFQQLPDVDAVIYPPSGGSRAIEGVEGLRMTWGRAVILEAMRRYLQQRRAMEPWEDPAGISHLEIQKLMYFANEADPDLALDFTPGRYGPYSERVRHLLQGMEGAFTVGLGDGTARVLANQPISLTTKGTDAITDYLATDAAADRVSAAVDTVLRVIEGFEGPYGVELLASTHWVATREGAKEPATAAAAVRKWTKRKGRMYSDDRIGVALDRILMTA

SEQ ID NO: 8531 - protein, 352 aa, Mycobacterium tuberculosis SUMu007; identical to SEQ ID NO: 8512

SEQ ID NO: 8532 - protein, 352 aa, Mycobacterium tuberculosis SUMu008; identical to SEQ ID NO: 8512

SEQ ID NO: 8533 - protein, 352 aa, Mycobacterium tuberculosis SUMu009; identical to SEQ ID NO: 8512

SEQ ID NO: 8534 - protein, 352 aa, Mycobacterium tuberculosis SUMu010; identical to SEQ ID NO: 8512

SEQ ID NO: 8535 - protein, 352 aa, Mycobacterium tuberculosis SUMu011; identical to SEQ ID NO: 8512

SEQ ID NO: 8536 - protein, 352 aa, Mycobacterium tuberculosis SUMu012; identical to SEQ ID NO: 8512

SEQ ID NO: 8537 - protein, 353 aa, Nitrosococcus halophilus Nc4 uid46803
MIEYTKGNLLKADVEALVNTVNTVGIMGKGIALMFKEAFKDNFDAYAAACKAGEVKIGQMFTTETGNLMGPQWIINFPTKKHWRNKTKLAWIEEGLEDLRRTIIKYGIDSIAIPPLGCGNGGLDWREVRPLIEKCLVDLNGIHILVYEPTQKYQNVAKRKGVQTLTPARALIAELVRRYWVLGIECSLLEIQKLAWFLERRLEESGLDNPLQLDFKANRYGPYADRLRHLLDALDGSYLRCDKRLADAKPEDTIAFNDTQKEYVATYLKSKAKAYLPALEATTKLIDGFESPLGMELLATVDWLLVREHCKPEVEDVKRGIAHWPASRSAALRKQRIFDDRLISLALERLAAY

SEQ ID NO: 8538 - protein, 352 aa, Nitrosomonas europaea
MIEYTSGDILRCEADALVNTVNCVGVMGRGIALQFKNMYPANFKAYEAACKREEVQPGRMFVFETKQLTPPRLIINFPTKRHWRGKSRIEDIEAGLVDLVNVIRDKNIRSIAIPPLGAGLGGLDWKEVRPRIEHALGELEGVQVIVYEPNGAPASDKMAHVREVPKMTSGRAALVELMQRYLSGLLDPFVTLLEVHKLMYFMQEAGEPLRLDYIKHHYGPYAKNLRHVLNAIEGHLIAGYADGGDAPDKPLSLVPGAVAEAKSFLDQHEISRARFERVTRLVEGFESPYGLELLATVHWVIHREGATQSDSVKRQIYQWNDRKRQFTQRQLVIAEERLRSQGWLSPETTFTY

SEQ ID NO: 8539 - protein, 349 aa, Oscillatoria sp. PCC 6506
MIELTQGNLLDADAEALVNTVNCVGIMGKGIALQFKQAFPENFRQYAQACRSSKVQPGQMFIVSTGNLFNPRYIINFPTKRHWKGNSRIEDIEIGLKALIAEIKRLNIKSIAIPPLGCGNGGLSWTQVKPLIESAFIYLPNVKVLLFAPQNTPEVDRMRVATENPKMTRARALYIRLLELYRLPGYRLTMLEIQKLAYFLQVAGESLKLQYTRDKYGPYANNLHHVFQTLEGHYIRGYGDRSQEAQVYVLPEGKKAAETFLENNPDANARLERVSRLIEGFETPYGMELLATVHWVTQEDQEAVEDVEKAISLVKEWSIRKRDLFKPQHIRKAWQRLREENWLFHIKFD

SEQ ID NO: 8540 - protein, 345 aa, Parvibaculum lavamentivorans DS-1
MGHAVIEFRTGDILDADVEALVNTVNCVGIMGRGIALQFKNAFPENFKAYKAACDCQEVQPGKMFVFETHKFTGPRFVINFPTKRHWRGKSRMEDIDSGLKALVGEIRQRGIRSIAVPPLGSGLGGLVWADVRPRIKAALQDIEGLKVIVFEPSAAVVTTKSREIPKMTAGRAALVVLMYRYLGGLMDPFVTLLEIHKLLYFMQEAGESLRLKYAKAPYGPYAENLRHVLSAVEGHLVSGYADGGDTPDKQIELVPGAVQDAEAYLDHNTDTISRFDRVGKLVEGFETPFGLELLATVHWVVTRENASSAEEAAEKVYAWSDRKKRFTPRQIAIAFDTLRSKGWA

SEQ ID NO: 8541 - protein, 355 aa, Pectobacterium carotovorum PC1
MITFTQGNLLDAPVEALVNTVNTVGVMGKGIALMFKERFPANMKAYALACKQKQVMTGKMFITETGELMGPRWIVNFPTKQHWRADSRMAWIEDGLQDLRRFLIEKQVQSIAIPPLGAGNGGLNWPDVRAHIESALGDLQDINILIYEPTEKYLNVAKSTGVKKLTPARAMIAELVRRYWVLGIECSLLEIQKLAWLLQRAIELHRQDDVLKLRFDAHYYGPYAPNLSHLLNALDGTYLKAEKRIPDSQPLDVIWFNDREKDRIEAYLNSEAKEWLPALKQVSQLIDGFESPFGMELLATVDWLLARGECQPTLDSVKEGLSQWPAGERWASRKMKLFDDNNLQFAINRVMEFHR

SEQ ID NO: 8542 - protein, 349 aa, Pedobacter sp. BAL39
MIYKVGNLLEATTQALVNTVNTVGVMGKGIALQFKERFPQNYKLYADACKKGLVEVGKMLVVTERTLEGEKIIINFPTKQQWFKKSQYSFIEEGLKALVQEIKDRDIKSIAIPPLGCGNGGLKWEKIRPMMDRYLSDLQGVEIVVFEPNDAVKEILQNEQTKKEVSLTPGRAMLLYALFRYERLGEVASIFAANKLAYFLQESGEKLKLQFTAYTYGPYAQAVEKVLYSMNGKYLSGLEQMQAKPFEPLKLNWERLTEVEHYIKTSLSDDQRQRIEGLFRVIDGFESTLSLEILSSIHYLLSQDPKLSKQELLLKIQAWNERKKQVIKEEYIGIALEHLDNYSRQLKFA

SEQ ID NO: 8543 - protein, 350 aa, Prevotella timonensis CRIS 5C-B1
MISYTTGNLFDSHAQALVNTVNTQGVMGKGIALQFKERYPNNYKSYRQACKDQKVVIGKMFITEEREMDGNKRLIINFPTKQHWRNSSQYSYISSGLQDLRQEIIDRDIASIAIPALGSCNGGLDWNNVKRMIEEYLHDLDCQIMIYEPNALIIDRMKKEKAKLTPARAMLLSVLCDMVLEDGTPSEFAAEKIAFFLQEFGAKDAFRLQFQKGYYGPYSGKVKYVLHYLNGSYIMGMETMNNKPFDDFWLTGDAANVVSEYLHKKENQRWLGIAERTKEFLRGFYSNYMLELLATIAYLSKTDKTLLNAKTEEEKIETIGRDLAQWSNRKGKMFHKDKYIGMALQHLRDK

SEQ ID NO: 8544 - protein, 362 aa, Pseudomonas entomophila L48
MIRFTQGNLLEAKAEALVNTVNTVGVMGKGIALMFKERFVENYRLYAAACKADEVVTGKMFITEVRELDGPRWVVNFPTKRHWRSPSQLAWITDGLHDLRSFILANDVSSIAIPPLGAGNGGLPWAAVREQIEVVLGDLDADVLVFEPTSKYQNVSKRTGVEKLTPARALIAELVRRYWVLGMECSLLEIQKLAWFLERSIERFTPDDNPLNLQFSAHKYGPYTNRLEHLLNNLDGSYLHCDKRIGDAGPLDVIWFDEGRKAFVDTYLHSEAKVHLPALEFTAELIDGFESPFGMELLATVDWMLHRDGVAPTVDAIREGLQNWSGGKEAAARKNALFDDDSLATALKKLSVFQAQGVVQVH

SEQ ID NO: 8545 - protein, 360 aa, Pseudomonas mendocina ymp
MIRFTQGNLLEAKVDALVNTVNTVGVMGKGIALMFKERFAENYRLYAAACKAKQVETGKMFVTPVQELDGPRWIVNFPTKRHWKAPSKMEWVVEGLTDLRTFILDNHIESIAVPPLGAGNGGLEWMAVREQIEAVLGDLHAEILVFEPTSQYQNVAKRSGVEKLTPARALIAELVRRYWVLGMECSFLEVQKLAWFLERGIERFSPADNPLNLQFVAHKYGPYANRLEHLLNNLDGSYLHAEKRISDSDPLDVIWFDDERKAYLQAYLNTESKPYLEALERTADLIDGFESPFGMELLATVDWLLAKEHVEATVPAVRQALRKWGGGPGAATRKDRLFDDRALAIALERLTQSGFSAVAA

SEQ ID NO: 8546 - protein, 345 aa, Rhodopseudomonas palustris TIE 1
MAIRLVTGNLLERRVDAIVNTVNTVGVMGKGIALQFKRKWPANAKAYEAACKRGEVVPGKMFVFDNGGLIAPKFIINFPTKRHWRQPSRMADIEAGLVDLIVQIRHLQIRSIALPPLGCGNGGLDWDQVRPKIEAAFRELPDVDVELFAPAEAAGVRQLEPEAQKPRMTPGRAAILKLLSIYREMRYPLSQIEIQKLVYFLASAGQAMGSLTFKKHIYGPYAPELRHVLTKMDGAYLHGVGDGSKPSEITVVGEALREAEAFLNSHQDFETVRRVEQIARLIDGFETPYGMELLATVHWTANETKTTDLNRIVEAVHSWNERKRQIMLPANIKSARDRLVTEQWL

SEQ ID NO: 8547 - protein, 354 aa, Roseiflexus sp. RS-1
MIEYVTGNILEAEVEALVNSVNCVGVMGRGVALQFKKDWPENFKAYAAACRRQEVQPGRMFVFETGNLFPRYIINFPTKRHWRGKARIEDIEAGLSALVEEIQRRGIRSVALPPLGCGLGGLEWSEVRARIEETLAGLVDVRILVFEPTEVQPLPRSMRRGPVPSMTPGRAAMVVLMERYLVGLLDPFISLLEVHKLMYFLQEAGEPLRLRFTKGPYGPCAENLRHVLSAVEGYYISGFGNGGDQPDKVLELVPGAIDDARRVLDQQPEMRERFERVGRLVEGFESPFGLELLATVHWVATRERPATEEELIEHVYAWAERKRQFSRDQILLAARVLAEKGWIEGVLAETVGGS

SEQ ID NO: 8548 - protein, 345 aa, Roseovarius nubinhibens ISM
MTITFKRGDLFSEPVEALVNTVNCVGVMGKGVALEFKKRWPANFKAYRKLCENKELIPGRMFIFDTKELFPSEGPRYLVNFPTKAHWRSKSKISYVEDGLDALRGEITTHGIKSIAIPPLGCGNGGLDWSDVKPLILSKLSDLEDVEIVVFPPKDSMDEPEHLHSNLPMTYARAMLLRGLSDLERYFDGSFDRVSLQKIAYFLQAFGVDFKLKFARNLYGPYSENLKKAYVALENHGMISGFLTGDRQAHVTPSGCAVADEFLSESDHGSEQIIDRLSKLIQGYESPYGLELLSSVHWLAHHEGHYPVEKIIDEMMSWNENKRNTFGEDAIRAAYGRLKEDGLLN

SEQ ID NO: 8549 - protein, 371 aa, Ruminococcus flavefaciens FD-1
MKILIGNLFDSKAQTLVNTVNCVGVMGKGIALEFKKRYPLMFDEYSNKCKLKEVKPGTPYLYQDITGVSVLNFPTKDNWRSPSKLSYIVDGLDWFVRNYEQLGIRSIAFPPLGCGNGGLTWELVGPIMYNKLSTLPIDIEIYAPFGTKAEHVSVSYLCDNYKEYNADVEGMKNASVRHSWYLILEVIKSLNTNRYSLHVGRVIFQKICYILTRLGVDTGFVFTQGSYGPYSDDIKRATVALSNANMIYEKNFGNMIEVTVDNSFKLHSAEYSETELDAVNKTVDLFSRVKNTEQVEMIATVIYAFDQLMKDNHYVSDEEVYKYVMEWKKRWKDSKQKEVCNTIINLAMLGWINIDFSNKLSILTEGDYELN

SEQ ID NO: 8550 - protein, 346 aa, Shewanella putrefaciens CN-32
MIEITHGDILRADTEAIVNTVNCVGVMGRGIALQFKKAWPDNFKAYAAACNSKNVQPGKMFIFETGQLANPRFIINFPTKRHWKGASRIEDIESGLVALVADIQRLGIKSIAIPPLGAGLGGLDWLVVRDKIEAAMQPLTDVQILLYEPAGAPQNDRIAKQKEVPKMTAGRAVLIELMQRYLKGLLDPTVSLLEVHKLLYFMQEAGEPLRLKYEKAHYGPYAQNLRHVLNAIEGHFISGYADGGDKPEKELRLVPGAVKEAQEFLEQHPDTRERFTKVSELVEGFESPLGLELLATVHWLNKYEHVRSTDQVIESVHSWNTRKQLFTARQITIAEKVLARQNWLSA

SEQ ID NO: 8551 - protein, 345 aa, Stigmatella aurantiaca DW4/3-1
MTIESGKGNLLTAEVDALVNTVNTEGVMGKGLALQFKKAFPENFVSYERACKAGEVVPGRMHIVHRLASPRFIINFPTKKHWRNPSKLEYVRDGLRDLVTHVRKLGIQSIAIPPLGCGNGGLDWADVKPLIVQSFEALHDVRVVLFEPADAPSADKIIDRRETPVMTPARGAILALMGRYIETGYNYRLSLVEVQKLAYFLQDAGEPLRLEYRAHHYGPYADNLRKALRNIEGHYTRGMGDGKNSPETPLELLPNTVTSAREFLKTRPETLARLERVVQLIDGFETPFGMELLGTVHWVMRHEANSGDVEGVIAKVHAWSERKRSQMKDGHIRAAWTRLHAQGWA

SEQ ID NO: 8552 - protein, 348 aa, Synechocystis sp. PCC6803
MFECKSGNILTEDTEALVNTVNCVGVMGRGIALQFKKAFPENFKAYAQACKEEKVKPGEMFVFQTGQLVNPRFIINFPTKRHWRTHSRIDDIENGLKALKCTIQKYKIRSIAIPPLGCGLGGLDWAEVKTRIEVILKPLDNVQIILYEPHGELSQAKTVQSLRAPKMTPGRAVLVELVSRYLQGLLDPFITLLEIHKLMYFMQESGEFLQLRYAKAPYGPYAENLRHVLNVIEGHLITGYADGGDQPNKPIALLPNAIEKATTFLQDYPETHTRFEKVTDLVEGFESPFGLELLSTVHWIVKNEPVNSLSDVIDRTYAWNQRKQQFTQRQIELAVNVLNKKGWINRPY

SEQ ID NO: 8553 - protein, 370 aa, Syntrophothermus lipocalidus DSM 12680 uid49527
MVKVVVGDIFESQAQTLVNTVNCVGVMGKGIALEFKKRFPEMFADYQARCARNEVRVGYPYLYKSLVPPWVLNFPTKRHWRSLSRVKDITKGLDYLVQHYREWGITSLAVPPLGCGQGGLEWRVMGPILYGALSRMDIPVELYVPAGTPDWQLDADFLGSLSSPTRGRNRSEETMEFNPAWLVLVEILKRLEEEPYHWPIGRVTFQKIVYVSTREGIPTGLQFGRSSYGPFSPGLKALMTRLVNMGLICEKPLGRMIEVRVGPAYKDVRTKYQAQIEQWGGVIDRIVSLFMRMKTNQAEIVATVLYVNSELMERTGEKPTERDVLNEVMLWKQRRRPPLDENEVAVAIRNLAALGWAQVRASMNLRLYGE

SEQ ID NO: 8554 - protein, 351 aa, Thauera sp. MZ1T
MIKLTQGDLLKQDDVDAIVNTVNCVGVMGKGIALQFKNKWPDNFAEYAAACKAGQVRPGRMFIHDSGGLVKPNYIINFPTKDHWRGASRMAFIRDGLIDLVTQVRRLGIRSIAIPPLGCGNGGLDWTQVRPLIEASFEALPDVEVRLFEPGGAPNPKTMEVRTKRPRMTPGRAAIVKVLSTYGELNYGLSKIEVQKLAYFLQEAGEPLQLQFVKHHYGPYSDTLRHALNTMEGHFIRGLGDGVVEAEIEPTEDALAEAEAFIANEGHSALSARVERVGRLIDGYQSSYGMELLASVHWVAAHEPGVRSVDEAITAVHGWNDRKKLLMQPDHVKFAWHRLAEEGWLSSSAFP

SEQ ID NO: 8555 - protein, 360 aa, Thermus aquaticus Y51MC23
MLRFVRGNLLEAPVEALVNTVNTVGVMGKGVALQFKRAFPDNYQAYVKACERGQVQIGRIFVYDRGPLAQPRYIFNFPTKKHWRHPSRMEYVEEGLKDLVCRIQELRVRSIALPPLGAGNGGLPWPEVKQRIQEALEALEGVEVWVYEPVENPKAHSIVPLKTKPRLTPARAALLKLFGLYGALGEPLGRLEAQKLAYFLQEAGLDLKLDFACKQFGPYAEPLNHVLARLEGHYIQGFGDRTGISQIRLKPQALDEAVLFLADYPKADEAATRAADWVKGFETPYGLELLATVHWAVRHEGARDWASLQKRLQAWNPRKATFPKTHLQVALDALLKRGALRPEEWQDRPPKLPANVAQEA

SEQ ID NO: 8556 - protein, 331 aa, Thiobacillus denitrificans ATCC 25259
MDAIVNTVNCVGVMGKGIALQFKNKWPANYSAYEAACKAKQVRPGTMFVFDSGGLVKPNYIINFPTKDHWRGKSRVEFIRDGLVDLVAQVKRLGIRSIAIPPLGCGNGGLEWDEVRPLIEQAFAVLPDVEVRLFAPAGAPDPKSMEVKTSRPKMTAGRAAILKVLDTYRSLEYGLSRIEVQKLAYFLQEAGESLSLSFVKNQYGPYSDQLRHALNRMEGHFIRGLGDGVVDAEIEPLEDALAEAEQYVSASGHAALARHVERVANLIEGFQTPYGMELLATVHWVATHEPTAHSFDQVVSAVHAWNERKARIMQPAHVRAAWSRLDAQGWL

SEQ ID NO: 8557 - protein, 359 aa, Zymomonas mobilis
MIIFTQGNLLEAKVEALVNTVNTVGVMGKGIALMFKERFHENFRLYSAACKAKEVQIGKMFVTPVYELGETRWIVNFPTKQHWRNPSRIEWIIKGLQDLRRVLLEKNIKSIAIPPLGAGNGGLSWKDVRGQIELALSDLDIDIFVFEPTSQYQNVAKRTGVEKLTPARALIAELVRRYWVMGIECSLLEIQKLAWFLQRAIEQYSPDNNPLNLDFQPHKYGPYTHQLNHLLNSLDGSYLHSDKRISDSDPLDVILFVNKRKDDLQAYLKSEAKPYRQALESAAMLIDGFESPFGMELLATVDWLLTRENIEPNVPALRKGLRSWRGGEDAALRKDRIFNDRSLGIALDRLTKTSTLAIA

SEQ ID NO: 8558 - protein, 351 aa, Arthrospira sp. PCC 8005
MIHFKQGNLLTEKADALVNTVNCVGVMGKGIALQFKQAFPENFRAYKTACDAKRIHPGQMFVVATDKLFPKYIINFPTKRHWKGKSKIEDIKAGLIALVEEVKRLEITSIAIPPLGCGNGGLDWAAVKPLIVQSFAEVPDIEVMIFEPTGAPVADQIPVATSTPKMTIGRALLIRLLELYGIPGYRLTKLEIQKLAYFLQVAGEPLRLRYVKHQFGPYADNLNHVLQKIEGHYIRGYGDRTETSAMYVLEKGRDAADRFLSAHPDTGARLQRVSDLIEGFETPYGLEMLATLHWVATEDPQAAIDCDRAIEKVQEWSDRKRHLFKPNHLRIAWERLDTQNWFDINSDDEIQ

SEQ ID NO: 8559 - protein, 351 aa, Arthrospira sp. PCC 8005
MIHFKQGNLLTEKADALVNTVNCVGVMGKGIALQFKQAFPENFRAYKTACDAKRIHPGQMFVVATDKLFPKYIINFPTKRHWKGKSKIEDIKAGLIALVEEVKRLEITSIAIPPLGCGNGGLDWAAVKPLIVQSFAEVPDIEVMIFEPTGAPVADQIPVATSTPKMTIGRALLIRLLELYGIPGYRLTKLEIQKLAYFLQVAGEPLRLRYVKHQFGPYADNLNHVLQKIEGHYIRGYGDRTETSAMYVLEKGRDAADRFLSAHPDTGARLQRVSDLIEGFETPYGLEMLATLHWVATEDPQAAIDCDRAIEKVQEWSDRKRHLFKPNHLRIAWERLHTQNWFNINSDAETP

SEQ ID NO: 8560 - protein, 344 aa, Desulfonatronospira thiodismutans ASO3-1
MIEHVQGNILNAQTEALVNTVNCVGVMGKGIALQFKKAFPENFKTYRNACQRGEVKPGRMFVFDTGQELPRYIINFPTKRHWRDKSRYEDIEAGLQALVKEITARNISSIAVPPLGSGLGGLDWAKIKPMIERAFSDLPNVQIQLFKPEGSPQASEMPVGSDRPHLTTARALFIKLMQQYKRFAYRLTLLEIQKLAYLLQESGLNLRLSYVRHYYGPYAHNLNKVLEILEGHYISGYGDTQKPDVEIKLLPDAIDAADVLLSKHLEAYKHLNRVADLVDGFETPYGMEMLSSVHWLAVHERLAVDQQSAISAMAGWNERKKCLFKPEHICIAWDRLQEEGWITY

SEQ ID NO: 8561 - protein, 363 aa, Methylobacter tundripaludum SV96
MITFTQGNLLEAPVEALVNTVNTVGVMGKGIALMFKERFAENFHLYAMACKAKQVQTGSMFVTEVHELGDGPRWIINFPTKQHWRASSRMEWIIDGLQDLRRFLVEQHVKSVAIPPLGAGNGGLEWAAVRMQIERALGNLDVEILVFEPTQKYQNVAKRTGVEKLTPARALIAELVRCYWVLGMECSLLEIQKLAWFLERAIEQFSPGDNPLNLQFVAHKYGPYANRLSHLLNNLDGSYLHCDKRISDTDPLDVIWFDDERKAYLQTYLKTEAKAYIPALEYTTALIDGFESPFGMELLATVDWLLSKENVAPTVEAIYEGLKRWPAGAAERKSRLFDRHTIGIALERLIHPPIPQRPEVVDV

SEQ ID NO: 8562 - protein, 352 aa, Mycobacterium tuberculosis 02 1987; identical to SEQ ID NO: 8512

SEQ ID NO: 8563 - protein, 352 aa, Mycobacterium tuberculosis 94 M4241A; identical to SEQ ID NO: 8512

SEQ ID NO: 8564 - protein, 352 aa, Mycobacterium tuberculosis C; identical to SEQ ID NO: 8512

SEQ ID NO: 8565 - protein, 352 aa, Mycobacterium tuberculosis CPHL A; identical to SEQ ID NO: 8512

SEQ ID NO: 8566 - protein, 352 aa, Mycobacterium tuberculosis EAS054; identical to SEQ ID NO: 8512

SEQ ID NO: 8567 - protein, 352 aa, Mycobacterium tuberculosis GM 1503; identical to SEQ ID NO: 8512

SEQ ID NO: 8568 - protein, 352 aa, Mycobacterium tuberculosis Haarlem; identical to SEQ ID NO: 8512

SEQ ID NO: 8569 - protein, 352 aa, Mycobacterium tuberculosis K85; identical to SEQ ID NO: 8512

SEQ ID NO: 8570 - protein, 352 aa, Mycobacterium tuberculosis KZN 4207 (DS); identical to SEQ ID NO: 8512

SEQ ID NO: 8571 - protein, 352 aa, Mycobacterium tuberculosis T17; identical to SEQ ID NO: 8512

SEQ ID NO: 8572 - protein, 122 aa, Mycobacterium tuberculosis T85
MITYGSGDLLRADTEALVNTVNCVGVMGKGIALQFKRRYPEMFTAYEKACKRGEVTIGKMFVVDTGQLDGPKHIINFPTKKHWRAPSKLAYIDAGLIDLIRVIRELNIASVAVPPLGVGNGR

SEQ ID NO: 8573 - protein, 243 aa, Mycobacterium tuberculosis T92
MITYGSGDLLRADTEALVNTVNCVGVMGKGIALQFKRRYPEMFTAYEKACKRGEVTIGKMFVVDTGQLDGPKHIINFPTKKHWRAPSKLAYIDAGLIDLIRVIRELNIASVAVPPLGVGNGGLDWEDVEQRLVSAFQQLPDVDAVIYPPSGGSRAIEGVEGLRMTWGRAVILEAMRRYLQQRRAMEPWEDPAGISHLEIQKLMYFANEADPDLALDFTPGRYGPYSERVRHLLQGMEGAFTVG

SEQ ID NO: 8574 - protein, 348 aa, Providencia rustigianii DSM 4541
MKVIEITRGDLLRADVEAIINTVNCVGVMGRGIALQFKKAWPDNFKAYADACKKKQVQPGKMFIFTTQELANPRFIINFPTKRHWRGASLIEDIDSGLSALVKDIRKLGIKSIAIPPLGAGLGGLDWTIVRQKIETAMEPLDDVHVLIYEPSEDVGNVRVAQQQEIPKMTTGRAVLIELIQRYLKGSLDPSISLLEVHKLLYFMQEAGEPLRLKYQKAHYGPYAENLRHVLNIIEGHFISGYVDGGDIPNKELHLISGSVEMAQKFLQQYPETRERFERVSALVEGFESPQGLELLATVHWLHKYEQAKTTQELLAALDEWNERKQIMTERQVQIAKEVLSTKNWLVE

SEQ ID NO: 8575 - protein, 133 aa, Acidovorax delafieldii 2AN
MNTLNRIRRSVANRSDDVLLRGEFDQFGSAAQVGRALRELVLDGTLVRLGLGVYAKAKPSVLTGKPIPVRPLEVLAPQALNKLGVTVMASRLTREYNAGQSTQVPAGITLNVGRRRIARKLGFNGKAIQYEHA

SEQ ID NO: 8576 - protein, 133 aa, Acidovorax sp. JS42
MNTLNRIKRSVANRSDDVLLRSEFDQFGSAAQVGRALRELLMNGTLVRLGLGVYAKAKPSVLTGKPIPVRPLEVLAPEALNKLGVAVMASRLTQEYNAGRSTQVPAGIVFNVGRRRIARKLGFNGKAIQYEHA

SEQ ID NO: 8577 - protein, 146 aa, Burkholderia pseudomallei 1106a
MILRDKLRKALGRKKANVFLRADFEKLGSDAQLSRALRNLVDEGAVVKIGVGVYAKAKRSALSGKPIPVEPVEFLAPEALKKLGVKVYPSRRTAEYNAGQTTQIPAGVVINTGNRRISRKLGFGQKTIEYENNYNRPTGVDRRPAR

SEQ ID NO: 8578 - protein, 146 aa, Burkholderia pseudomallei 14; identical to SEQ ID NO: 8577

SEQ ID NO: 8579 - protein, 146 aa, Burkholderia pseudomallei 9; identical to SEQ ID NO: 8577

SEQ ID NO: 8580 - protein, 146 aa, Burkholderia pseudomallei B7210; identical to SEQ ID NO: 8577

SEQ ID NO: 8581 - protein, 101 aa, Burkholderia pseudomallei Pakistan 9
MVKIGVGVYAKAKRSALSGKPIPVEPVEFLAPEALKKLGVKVYPSRRTAEYNAGQTTQIPAGVVINTGNRRISRKLGFGQKTIEYENNYNRPTGVDRRPAR

SEQ ID NO: 8582 - protein, 140 aa, Chlorobium limicola DSM 245
MKSRLNMRERMIRSITMRRGEIIMRSDFTLMGSQSQISRLLADFVSEGRLVRLGYGIFAKARISSISGKAVPREPLEVLAQEAFRRLMIEAKPGKAQKEYASGQSTQVPVQAVFDTGQRRISRKLTVGNRKVRYENDYSA

SEQ ID NO: 8583 - protein, 141 aa, delta proteobacterium sp. MLMS-1
MSRLSVKERMVRSIALRKGEVILRADFESMGSPSQISRALKELIEAGKIVRLGYGVYAKARPSTLSGKPVPRVSLEELAQEALEKLGVPVQLGRAQAAYAEGKTTQIPVRTTFNTGRRRISRKITVGNSTVRYENNYSART

SEQ ID NO: 8584 - protein, 137 aa, Desulfatibacillum alkenivorans AK 01
MPVKNTLESKITYRVKRSKTPVFVRDDFKDIGGYDQVGRILRGLVKKGVLVSLGYGAYARSKRSSVSGAVVPEKPLPELAKELLKKLGVKVVPSSAERAYNSGKTTQVPTGRVIGVKGRIVRRIGYNGRYISFEKVS

SEQ ID NO: 8585 - protein, 131 aa, Escherichia coli 83972
MTTKDRIQSRLNRSKRYVFTRDDFRDIAGYDQVGRALRTLVNEGKLMKVGYGVYTKARRNIITGKIMPAAPGGSAAVITEALERLNIRYRLAGATECYNKGQSTQIPVSLGIKTPSRFKRMLIVGKSKINA

SEQ ID NO: 8586 - protein, 131 aa, Escherichia coli ABU 83972; identical to SEQ ID NO: 8585

SEQ ID NO: 8587 - protein, 131 aa, Escherichia coli FVEC1302
MTTKDRIQSQLNRSKRYVFTRDDFRDIAGYDQVGRALRTLVNEGKLMKVGYGVYTKARRNIITGKIMPAAPGGSAAVITEALERLNIRYRLAGATECYNKGQSTQIPVSLGIKTPSRFKRMLIVGKSKINA

SEQ ID NO: 8588 - protein, 131 aa, Escherichia coli FVEC1412; identical to SEQ ID NO: 8587

SEQ ID NO: 8589 - protein, 154 aa, Escherichia coli MS 119-7
MSYVCYLKCRIFATLYAMTQEANMTIKARIQSRLKRSKRYVFTRDDFKDIAGYDQVGRVLRDLVREGQLLKVGYGVYTKARRNGITGKVMPAAPGGSSAVIVETLERLKVRYRFAGATQAYNSGTSTQIPASPEIKTPRRFKRVLSVGNSRLNG

SEQ ID NO: 8590 - protein, 131 aa, Escherichia coli MS 198-1; identical to SEQ ID NO: 8587

SEQ ID NO: 8591 - protein, 131 aa, Escherichia coli MS 45-1; identical to SEQ ID NO: 8585

SEQ ID NO: 8592 - protein, 131 aa, Escherichia coli MS 69-1
MTTKDRIQSRLNRSKRYVFTRDDFRDIAGYDQVGRALRTLVNEGKLMKVGYGVYTKARRNIITGKIMPAAPGGSAAVITEALERLNIRYRLAGATECYNKGQSTQIPVSLGIKTPSRFKRVLIVGKSKINA

SEQ ID NO: 8593 - protein, 154 aa, Escherichia coli MS 69-1
MSYVCYLKCRIFATLYAMTQEANMTIKARIQSRLKRSKRYVFTRDDFKDIAGYDQVGRVLRELVREGQLLKVGYGVYTKARRNGITGKVMPAAPGGSSAVIVETLERLKVRYRFAGATQAYNSGTSTQIPASPEIKTPRRFKRVLSVGNSRLNG

SEQ ID NO: 8594 - protein, 131 aa, Escherichia coli UMN026; identical to SEQ ID NO: 8587

SEQ ID NO: 8595 - protein, 131 aa, Escherichia coli CFT073; identical to SEQ ID NO: 8592

SEQ ID NO: 8596 - protein, 131 aa, Escherichia coli W
MTIKARIQSRLKRSKRYVFTRDDFKDIAGYDQVGRVLRELVREGQLLKVGYGVYTKARRNGITGKVMPAAPGGSSAVIVETLERLKVRYRFAGATQAYNSGTSTQIPASPEIKTPRRFKRVLSVGNSRLNG

SEQ ID NO: 8597 - protein, 131 aa, Escherichia coli W, ATCC 9739; identical to SEQ ID NO: 8596

SEQ ID NO: 8598 - protein, 131 aa, Escherichia sp. 1 1 43; identical to SEQ ID NO: 8585

SEQ ID NO: 8599 - protein, 117 aa, Legionella drancourtii LLAP12
MRQDLIDLGSYRQVSRVFKKLIDTNKIVKIGAGIYAKASFSETLNKPLAQGTFGQVCKEALTRKGVQWEPGTAEQEYNAGLSTQVPARTVVRLKSRFRGTLSDGRRKLIIEKQINAR

SEQ ID NO: 8600 - protein, 150 aa, Legionella pneumophila Corby
MNRKSHYNNTFRDELRKKIDHITSRVFSRGDLIQDHSNQVQLRLNRALRTFMDEGIIIKIAHGLFAKAEPMSIPGRKIQAVLTEPFETVVTEALDKLGIKWELGSAIRDYNAGKTTQVPAVFSVRLKSRYRGSIHAEGRKLIFEGGINAR

SEQ ID NO: 8601 - protein, 142 aa, Legionella pneumophila Lens
MTVKYKDSLEYKALQRIKKIRSNVVLRQDLIDLGSYRQVSRVFKKLMDDNKLVKIGAGVYAKAYLSEMLNVPIIQGGFEQACKEALTKKGIEWELSTAAQEYNAGRTTQVPVRTSVRLKSRYRGTLSFGKRKLIAEKQINAR

SEQ ID NO: 8602 - protein, 150 aa, Legionella pneumophila Paris
MNRKSHYNNTFRDELRKKIDHITSRVFSRGDLIQDHSNQAQLRLNRALRTFMDEGIIIKIAHGLFAKAEPMSIPGRKMQAVLTEPFETVATEALDKLGIKWELGSAIRDYNAGKTTQVPAVFSVRLKSRYRGSIHAEGRKLIFEGGINAR

SEQ ID NO: 8603 - protein, 135 aa, Methylovorus SIP3 4
MKLSIKDRINKSIKASKANVFVRSDFKKFGGYDQVGRALKEVIEAGNLVKMGYGVYSKAEKSALSGKPIPIATITEAGLMVMNKLGVKADVGYFARLYRDGKTTQIPMKEVIAVEKPITRKIYFGKRVLEYEKYK

SEQ ID NO: 8604 - protein, 138 aa, Chlorobium luteolum DSM 273
MKSFRTTLLSQVRSRIDRKRNAVVLRQDFRDLGQYDQVGRCLLRLVKEGRLIKIGQGIYVRAAVSPLDEQPALPKSLNSLAVEAMQKMGIPTGPTAAERDYNEGKSTQVPTGRTIGVCKRVRRHIGYNGYTMKFEHVT

SEQ ID NO: 8605 - protein, 138 aa, Pelodictyon phaeoclathratiforme BU 1
MKKLQETLLFKMSSRIRRKRNDVLVRQDFLDLGGYDQVGRCLLRLVKEGTLIKIGQGIYVRATLSPIDARPSLPKSLNSLVLEALKKLDIPTGPTAMEIKYNAGNTTQVPTGRVIGVRKRVRRRIGFSGYSMRFEHAD

SEQ ID NO: 8606 - protein, 134 aa, Photobacterium sp. SKA34
MTTADRIYQKIKRSRRYVFERKNFEGVACYDQVGRALKQLVNQGELMKIGYGLYTKSRMNSLTGKPMPTHPGGTDALMREILKMKGVDFEIDSLSLQNISGESTQIPSSINYSWNSKQFNRKLVVGSRVIHSPN

SEQ ID NO: 8607 - protein, 131 aa, Photorhabdus asymbiotica
MTIKARIQSRLKRSKRYVFTRDNFKDLAGYDQIGRALRELVKEGQLLKVGYGVYTKARQNAITGKLMPAAPGGSVAVMIEALERLKVDYRLAGATSAYNSGKSTQIPASLEIKTSPRFKRTLSVGSSKLNG

SEQ ID NO: 8608 - protein, 131 aa, Photorhabdus luminescens
MIIKERIQARLKRSKRYVFIRDDFKDIAGYDQVGRILRGLVKEGQLLKVGYGVYTKARKNSVTGKIMPASPGGSDAVILEALERLKVKYHLDGASAAYTDGKSTQIPAYTQIKTTFRFKRVLSVGNSRLNG

SEQ ID NO: 8609 - protein, 132 aa, Pseudoalteromonas haloplanktis TAC125
MTIASKVTTRINRSKRYVFDRADFADIAGYDQVGRVLKKLVDNGHLLRIGYGLYTKARENRITGKLMPASPAGADGVILEAIEKLGVDYKFDEFSQRSINGESLQIPASLKIITNNRFKRKIVVNNSAINAN

SEQ ID NO: 8610 - protein, 144 aa, Rhodospirillum centenum SW
MRKPRTAKQQLAELVTRSNDDVFLPRDFTRASPDSAEYDTVLRAARALVREGMLVRLGYGVYARTRQSPITGKPMLTAPGGLEGAVRQALDKLKVVWQPGQAAQDYNSGRSTQIPVNASFRVANRFSRKISFRGKEVVFERSEV

SEQ ID NO: 8611 - protein, 136 aa, Shewanella baltica OS155
MAAVDSIFQKIKRSRRYVFERKDFDGIASYDQIGRSLNQLMDRGEIMKLGYGLYTKARVNSLTGRLMPTCPGGSDALMREILKMKDIDFEIDNLSLQSLSGKNTQIPSSVHYSWDQKQFNRKLVVGNRLLTPASRP

SEQ ID NO: 8612 - protein, 136 aa, Shewanella sp. ANA-3
MAAVDSIFQKIKRSRRYVFERKDFDGIASYDQIGRSLNQLMDRGEIMKLGYGLYTKARVNSLTGRLMPSCPGGSDALMREILKMKDIDFEIDNLSLQSLSGKNTQIPSSVHYSWDQKQFNRKLVVGNRLLTPASRP

SEQ ID NO: 8613 - protein, 145 aa, Synechocystis sp. PCC6803
MRRRRPTRRRVSSRIVTQSIADQIANSQQQVFMRQDFEDLGNYEQVGRSLRSLIQQNQLIRIGQGLYAKAQISPLSGKPVPRLGIKELAKEALQRLEVETFPSSYEKQYNDGKTTQVPTGRVIGVKGRVQRRIGYNGKYVKFEHV

SEQ ID NO: 8614 - protein, 143 aa, Verminephrobacter eiseniae EF01-2
MPRTRLSSMPSMTLQERIESSLSRSEAKVFLRKEFDRFGGYDQVGRALRGIIAKGLLVKAGYGIYVKAKKSSITGNPVPVAPLIEVGAAALAKLGGQAQPSSAAATYMAGRSTQMPMGDALCVGSSRVRRKIGFASKTVRFER

SEQ ID NO: 8615 - protein, 150 aa, Vibrio harveyi ATCC BAA-1116
MYTVSYTAVIVRKEVQMTAADRIYQKIKRSRRYVFERKDFDGFASYDQIGRALRQLVQQGELMKLGYGLYTKARINSLTGKPMPTNPGGTDALMREILKMKGVDFEMDSLSLQSLSGTSTQIPSSIQYSWDPKQFNRKLVVGSRVLNLPS

SEQ ID NO: 8616 - protein, 134 aa, Vibrio tapetis CECT4600; CIP104856; B1090 plasmid pVT1
MTAADRIYQNIKRSRRYVFERKDFDGFASYDQVGRALRQLVKQGELMKLGYGLYTKARVNSLTGRPMPTNPGGSDALIREILKMKGVDFEMDSLSLQSFSGESTQVPSSVHYSWNPKQFNRKLVVGNRVLNSPS

SEQ ID NO: 8617 - protein, 150 aa, Vibrio vulnificus CMCP6
MCTVSYTAVIVRKEVQMTAVDRIYQKIKRSRRYVFERKDFDGFASYDQIGRALRQLVQQGELMKLGYGLYTKARINSLTGKPMPTNPGGTDALVREILKMKGVDFEMDSLSQQSLSGASTQIPSSVHYSWNPKQFNRKLVVGSRVLNLPS

SEQ ID NO: 8618 - protein, 134 aa, Vibrio vulnificus M06-24/O
MTAVDRICQKIKRSRRYVFERKDFDGFASYDQIGRALRQLVQQGELMKLGYGLYTKARINSLTGKPMPTKPGGTDALVREILKMKGVDFEMDSLSQQSLSGASTQIPSSVHYSWNPKQFNRKLVVGSRVLNLPS

SEQ ID NO: 8619 - protein, 134 aa, Vibrionales sp. SWAT-3
MTAVERVYQKIKRSRRYVFERKDFDGFASYDQIGRALRQLVKQGELIKLGYGLYTKARMNSLTGRPMPTNPGGSDALMREILKMKGVDFEMDKLSLQSLSGKSTQIPSSIQYSWNHKQFNRKLAVGNRVLNSPS

SEQ ID NO: 8620 - protein, 132 aa, Yersinia aldovae ATCC 35236
MMTIKERIQTRLKRSKRYVFTRDDFKDIADYDQIGRVLRNLVKEGLLLRVGYGLYTKARKNSITGKIMPASPGGSDAVILESLDRLNVDYTLDASTTKYIKGETTQVPAYTQVKTSPRFKRALSVGNSRLNG

SEQ ID NO: 8621 - protein, 135 aa, Yersinia enterocolitica 8081
MILKQKLLRSIANRKGIVVLRSELEHLGSKSQVSKALSELVKEGVLIRVSLGVYAKTRFNRFAGKRTVAAPFETVVEETFKKLNVKVTQGKALEDYNAGRTTQIPMQLQVRTPGRKISRNITVSGKNVKYEKTYG

SEQ ID NO: 8622 - protein, 131 aa, Escherichia coli H591
MTIKARIQSRLKRSKRYVFTRDDFKDIAGYDQVGRVLRDLVREGQLLKVGYGVYTKARRNGITGKVMPAAPGGSSAVIVETLERLKVRYRFAGATQAYNSGTSTQIPASPEIKTPRRFKRVLSVGNSRLNG

SEQ ID NO: 8623 - protein, 256 aa, Nitrobacter hamburgensis X14
MTADGNIRAVVDALALPPGARVDARVPKKMLVEQGAPTPADKRAIQEGIDELQWFAACKPATIGVPAFSDDTREYLEIAVIGCAFRPAAKAGRLIELIHRAIPYPVLLITSDASGVAVSAAHKRKAQNEAGRTVIDRIVAATGLQPGAGDGAQLAFLQSVPLAQQPRSDLYALYAGWLARIEALNAARLTGAFVASDDSVTIDQRREALDAHTRLAKEIETLRGKARREKQLNRRVDMNMAIQRLEADLASYKKSL

SEQ ID NO: 8624 - protein, 253 aa, Syntrophomonas wolfei Goettingen
MLKTLMEIFNLPPKARMQRRMPKNTFYRNAELSKRDIKTFVNEIQLVQVVAILNSDSLRVAPFVNEEYNISDIAYLLVELKNKGQEGKVAHIIHTAIPYPLLIIFCYRQQVRFSTALKRLNKNDPTSIVLGDINISPWVDPIYPLPVQKAFLDSLALKTLPFDNLYRLYLALDNRIYLTGVIDLIGVYPSPEVDVNEVQEMLDKIDKLEKTINTLNTAMKRVTSFAHKMQHHVQIQQLQQQLDALITQLSEVC

SEQ ID NO: 8625 - protein, 254 aa, Pelobacter propionicus DSM 2379
MIPDDFIGALGLPDSALVNQRVPKKMLVENGAPTAADKRRINDGIEEIHWLAALKPNTIGVPEYCDDVQEYLEIAVLSVVLRPDAKAGRLAELFHRAIPYPLFLILVQGDQIVLSLTHKRRAQNEADKFVLDGDSVEVAVSGNPFLSTAVGRQFLDALALSHQPRASLLQLYQGWIDTLVALQASLISGTFCQAISKEAAIARLEAVKKCCDLEARITSLRNAAAKEKQMGRRVELNLEIKELRALVEIARKAL

SEQ ID NO: 8626 - protein, 259 aa, Acidovorax avenae citrulli AAC00-1
MSDAVNALHDAIVASLALPASCRVDQRVPKKMLAEHGGATAADRRLLTDGIEEAHWLAAIKPATTAIPTWRDEVREYLELAVLSMAARPTYAQPAQLQRLAELVHRAVPYLVLLIVSTPDAVAMSLSHKRTAQNEAGRVVLDGDVVSFQFSDELPDGLLDALALGQQPQQDLKALYQGWMDTLLAAQVARVTGHFSMDPTTDQAAMRRIALIEHQQLEAEAARLRALAGKESQIAKRVDQNLALQRLQAELAAVRARLQ

SEQ ID NO: 8627 - protein, 241 aa, Clostridium thermocellum ATCC 27405
MGDYSFLNIPDSCFIGSTIYKKLFYENANLSSSDKYLFSDIIDKIVWLYCLKPETINVQAYMDEVREYPEIEVIEVIVNKDYGLNRIAEIIMRTIPYPMLLIFKHEDKIRFYVAHQRTSQSDSSKNTIDEFISTDWLRNDSALFAKLDIKQMRFTNLYTLYSDIVDAISIYNLSAIMPTDDTITGDKARELSAKIEDIEQRIANLRSKLKKETQFNRRMELNIEIKRLEQSKNKLLGGDNE

SEQ ID NO: 8628 - protein, 267 aa, Delftia acidovorans SPH-1
MTMATSRALLDALQLPDSARVDQRVPKKLLLENGAPTASDKRLITDAIEEIQWLAALKPNTIGVPSYRDAQREYLEVTVLGLTLRGTVKPASLARLAELMHRAVPYPVLLLVQGQALTLSLAHKRWAQNEAGKVVLDGDPVLASLPHATEDTAAVEDAIAPEIERAFVQSLSIARQPQTTLHALYQGWMERVWALQAARLTGTYQADTTPEQAAARWQALADCERLENEIGRLRAQATKEKQLARQVELNLTLKRIQAELAAARRQL

SEQ ID NO: 8629 - protein, 250 aa, Natranaerobius thermophilus JW NM WN LF
MKEILSENMKVPDSCEVNKPIYKKLFYENAYLGKKDQELLSKNIEKITWLYSFKPDTINILPYNDKEREYEEIAVIEVLLREQSHIKRIAEIIQLTIPYPLIIIFNYGQKILFNVAHKRVNMSDESRNTYEELIFTDWVDLASLNKNDKKFIKSLDITKFSFTNFYWFYSDFVDRINIFNVSLYADEYLLEHDANDLKQIHDEIKDLEQRISQLQSDLKKEDHFNKKVKMNVEIKKLKEEKKNLIDKLNS

SEQ ID NO: 8630 - protein, 252 aa, Pelodictyon phaeoclathratiforme BU 1
MKSQALIAAFDLPESSLVNQRVPRKLLLENGAPTSADKRSINEGIEELIWIAALKPVTVGVPEFRDESHEYLEIAVLLLTLRDGAKTTRLVELVHRAIPYPVLLLTQQGAPLSLSVAHKRWSQSEAGKTVLEGDIVSVAWSREVDADIMADFRNSLALGSQPRTNLHALYQGWLDSMVALNAARVTGNFTLAENAEYAAARRDALRECGVLQEEIGRLRTLAAKERQIPRQVELNLELKRIDAELATTKQKL

SEQ ID NO: 8631 - protein, 252 aa, Acidimicrobium ferrooxidans DSM 10331
MNADAILAALDLPASCRVDRRVPKTLLLENGAPTGADKRQINESIEELVWVAALKPATIGVAEYRDAIREYLEIAVLRLTLRAGAKVQRLVELVHRAVPYPLLLITELGAQADLSAAHKRWAQNEAGKTVLDGELVVAELSPERDAGPWPAFSAALALGRQPRTALYALYQGWMDTLLALKAARVTGVFVLASDADHAAARQEALRECARLDAEIARLGTAAAREKQMSRRVELNLELKRAEAARAAARERL

SEQ ID NO: 8632 - protein, 168 aa, Maricaulis maris MCS10
MPDVVDSATRSRMMAGIKAKNTKPEMLVRRGLHAMGIRYRLHDKRLPGKPDLVLPKYRSVIFVHGCFWHGHDCPAFKWPKTREKFWREKISTNRKRDEKQISDLVRSGWRVSVVWECALRSKTPDKVETILKLLASWIEQREIAAEKSDDPTPFEVFPGSGDKDARCR

SEQ ID NO: 8633 - protein, 167 aa, Halorhodospira halophila SL1
MSDRLSPEHRSRVMSRVRGHDTKPELVLRRALHARGFRYRLHVRDLPGCPDLVFPRYSAVVFVHGCFWHGHDCHLFRMPSTREEFWEKKIGRNRERDRKNRAELLDRGWRVLEVWECAMRGKDRLPSGEMLERVETWLTGRTVTHEIRGLGGRHPGANDDSIYGEQA

SEQ ID NO: 8634 - protein, 144 aa, Rhodobacter sphaeroides ATCC 17029
MMTDSLTPDARSRNMAKIRGRDTGPEMRVRSAAHGLGLRFRLYRRGLPGTPDLVFPSRRVALFVHGCFWHRHPGCRFAYTPKSRVDFWEAKFEGNVSRDLRKNEDLEAAGWKSVTIWECETREPDKLSEIIRDRVVQLPVLPPD

SEQ ID NO: 8635 - protein, 154 aa, Acidiphilium cryptum JF-5
MPDIVDRQTRSRMMAGIRSANTRPERMIRSALHVRGFRYRLHPRALPGRPDIVLPRYRAAIFVHGCFWHGHDCGLFRLPGTRPEFWAEKIRRNRQRDAAVMNELVATGWRVLTIWECAIRRRRGMVPEPVIDEAVSWLRSGDGNLEIRGNNGAD

SEQ ID NO: 8636 - protein, 157 aa, Serratia proteamaculans 568
MADVHSPSIRSKNMRAIRNQNTAIEKLLSRVLDEAGITYRTQASDLPGKPDFVIDDYKAIIFVHGCFWHHHDCYLFKVPATRTEFWLKKIDSNVRRDNDVTRLLTEQGWRELIIWECSLKGRIKLSANALSERIEEWLCASDTHAVIDSKGIHQLNN

SEQ ID NO: 8637 - protein, 158 aa, Pseudomonas putida GB 1
MVDVHTPEARSRNMRAIRNKDTKPELLIRKALHARGFRYRLGGAGLPGHPDIVLPKYRTAIFIHGCFWHGHNCKYFKLPATRTEFWAGKIRSNQERDQRSTSLLVEQGWSVLTVWECSLKPSGPGVEAVLHEIEGVLAQSLNVRVSQLLVISGLTSKM

SEQ ID NO: 8638 - protein, 154 aa, Geobacter lovleyi SZ
MTDIVDKETRSRMMSGIRGKNTKPEFHIRSLLHRNGFRFRLHTKDLPGKPDIVFPRYRAVIFINGCFWHGHDCHLFKLPGTRTDFWKTKIARNKENDSRAMGLLAESDWRVATVWECALRGKFRMNDTVITERLAGWIRSAEIKLELRGIQPEV

SEQ ID NO: 8639 - protein, 124 aa, Pseudomonas syringae pv B728a
MSSLPVAKGWLRRGAKALVSFTWPVLLTIVLAVIFMTAIVHFFGDIEQFREWQKAHYNYMLAWRLSLYAAIGLGWYRLRRTLKQRASDTNLFPSGLRRCEVMAIFVILLFELRRAATVAGVDLP

SEQ ID NO: 8640 - protein, 119 aa, Burkholderia xenovorans LB400
MSPMHASWLRPRWLFSRRAVKTLLWLVLVVAAAVGANVAGIYLVGSVAAWEHWLAASAGYFFIWRLCLYGATVYGWVWMRRRLLAREDNAQARRRLIRAEVAGVVAIVALEASLLMQAA

SEQ ID NO: 8641 - protein, 118 aa, Cupriavidus metallidurans CH34 uid250
MSAARMTWRPLRWLFSRRAAKALLWTVLIVAAAVAANIAGIYLVGSVAGWERWLAAAAGYLFVWRLCLYGATVYGWIWMRRRLLVREDDAQARHRLVRTEIAGVVAIVALEASLLMQG

SEQ ID NO: 8642 - protein, 119 aa, Acidovorax sp. JS42
MSAMRMTWRPLRWLFSRRAAKALLWAVVIVAAAVGANVAGIYLVGSVAGWERWLAAASGYFFVWRLCLYGATAYGWVWMRRRLLVREDDAQARRRLVRTEVAGVVAIVALEASLLMQAG

SEQ ID NO: 8643 - protein, 123 aa, Acidovorax sp. JS42
MNQARMTWRPLRWLFSRRAAKTLLWFVLAVAAAVGVNVAGIYLVGSVSAWERWLAASAGYFFIWRLGVYGATAYGWLWMRRRVLAREDQSGTDGQARRRLIRAEIAGVAAIVALEAGLLTQAA

SEQ ID NO: 8644 - protein, 117 aa, Acidovorax sp. JS42
MSRLAWLRLPWLFNRRVGVALLWTLLVVAAAVAVNIAGIHVVGGVEGWQHWLQAHAGHFFVWRLCLYGATAYGWWWMRRRLLRREPSRETHQRLLRTEIAAVIAVVALEASQLLRHG

SEQ ID NO: 8645 - protein, 117 aa, Methylibium petroleiphilum PM1
MSRLAWLRLPWLFNRRIGVALLWTLLVVAAAVAVNIAGIHLVGGVEGWQHWLQAHAGHFFVWRLCLYGATAYGWWWMRRRLLRREPSRETHQRLLRTEIAAVIAVVALEASQLLRHG

SEQ ID NO: 8646 - protein, 119 aa, Parvibaculum lavamentivorans DS-1
MSPRANWLGRLFSRHAVKALLWTVVIIAAAVGANVVGIYLVGSVDGWEQWLAATAGYFLVWRLCLYGATAYGWVWMRRRLLAREAQNGADGQARRRLVRSEIAGVIAIVALEASLLMQG

SEQ ID NO: 8647 - protein, 123 aa, Serratia proteamaculans 568
MTGTENKGMSPRRGGRLGYRAKRVLQMLGMLVVAMVIALGMADWGVNHPGQSAVLHDWVHSTRYGWLSWRLVLYAVLTWGGWKIWHAPGCKPEYRQPLKRMAIACAVFALACEYSLFGGGLTL

SEQ ID NO: 8648 - protein, 123 aa, Delftia acidovorans SPH-1
MNPTRASWLRPRWLLNRRAAKALLWTVVLVAAAVGANIVGIFLVGSIDNWERWLTATAGYFLVWRLCLYGATAYGWVWMRRRLLAREAQRGADRQARRRLLRSEIAGVAAIVALEASLLLQAA

SEQ ID NO: 8649 - protein, 117 aa, Thauera sp. MZ1T
MSRLAWLRLPWLFNRRVGVALLWTLLVAAAAVAVNIAGIHVVGGVEGWQHWLQAHAGHFFVWRLCLYGATAYGWWWMRRRLLRREPSRETHQRLLRTAIAAVIAVVALEVSQLLRHG

SEQ ID NO: 8650 - protein, 114 aa, Thioalkalivibrio HL EbGR7
MRIGLPKWLFNRQLGRTLGWIALIVFVAVAVNLVGIRLVGDAHTWSRWLDEHAGYFLVWRLCLYGATAYGWIWMRRRLRERDTSREAHQRLLRAEVGAVAAIVLLEISVLLRQP

SEQ ID NO: 8651 - protein, 118 aa, Azotobacter vinelandii DJ
MDLQPRKKPNLLRELAVALVLTVGLVIAGVLLGSLAIQLFGGVEQWLTWRADNYLGLLAWRLCLYAGIATAWIGLRRRLPLPEPGPARNRLRRIEGLIVLLAAIVELIKAPVNWMEVL

SEQ ID NO: 8652 - protein, 117 aa, Ralstonia pickettii 12D
MTSRAWLRPAWLLGRRVGIVLLWVLLVAGIAVGVNVVGLHVVGSIDGWEQWLREHSGHFLVWRLLLYAATACGWWWMRRRLREREPSAEAHQRLLRVEIAAVATLVLLEGSQLLRNG

SEQ ID NO: 8653 - protein, 116 aa, Dickeya zeae Ech1591
MKFAWLQSHRLFSWRTPRVLLWIVSLLVITVTANVLGIHFVGSIAGWEHWLADTAGYFLLWRLCLYGATVYGWLWMRRRLLLRETRTDDRRRLIRAEVFGVGALLVLEFSLLVQYV

SEQ ID NO: 8654 - protein, 130 aa, Methanosarcina barkeri fusaro
MNLDLEAARTSQEIMKNTMGKQSKSVENLVTKTLGVLQENGIYACMLFLCSRSNTEKEIAKIIRSELLKMTDFVEKISLNSDNSKEIPDKEILEFLTNNICNDIDMLFFTKQLWEQTLIYTRYGAKARED

SEQ ID NO: 8655 - protein, 138 aa, Roseiflexus sp. RS-1
MTNTTSINLDYLAAKYAQTIIQKTKDKKASDIENTITKALGVLQEDGVYACFLYLLAREKENGAVVVDEMLNLLSSLPFGWQKPTNNSEILPFISEQVTKDLDRLLLAREVLEQMLIYARYGAKARDKGGSEAPGESS

SEQ ID NO: 8656 - protein, 129 aa, Roseiflexus castenholzii DSM 13941
MSNSTERNLDRLAAEYAQNIIKRTKDKKASDIDNTITKALGVLQENGVYACFLYLLAREKENGSVVVEEMLNVLNGLGFGWGKPADKRPEKVLAHVSDKVTADLERLLLAKETLEQMLIYARYGAKARE

SEQ ID NO: 8657 - protein, 130 aa, Thermotoga RQ2
MQEKISKNIDQICARYSIDIVNEMKSECDSKEIQSLVTKALGVLQQQGLYAFGLFCKAENKAEGILKKAIEMLREIGIMKNSNEEDLSSISNLSERIHDLMFAIEIVEKTLIYARYHAKALVKESSSHSE

SEQ ID NO: 8658 - protein, 124 aa, Chlorobium limicola DSM 245
MTQLNLDQLAARYAQKIVEKGKADIENPVTKALGVLQEQGVYACILYLLANKHDNILKPLYQLVGELPGFRGNEKMPDEKIDSKEMLKFYGDCVCSDLDTLLLVKELYEQTLIYARYGAKAAGK

SEQ ID NO: 8659 - protein, 137 aa, Prosthecochloris aestuarii DSM 271
MSEKTAILNLDYLAAKHAQQLVEDHSDIENTVTKALGVLQEHGVYACFLYLLAKEKEGNKGKNTAGHMIKLLQESKLVPEDNDLKKPIEILQYANEHISSAKLKKLLLIKDLLELMLIYSRYHANAMEPTNSREENT

SEQ ID NO: 8660 - protein, 123 aa, Chloroflexus aggregans DSM 9485
MSDAQMKNLDIQCAELGRELATISGMEEKIINAALAVLEEQGPYAMFLYLNARHSNVADKISDKSLKFLRGIFNARLNNAKDVLEATKHLADSLDDLLFARDLLRTALSYARYHLKAKGDKTP

SEQ ID NO: 8661 - protein, 129 aa, Chloroflexus aggregans DSM 9485
MSNSTQRNLDWLAAKYAQNIIKHTQDKKAGDVDNTITKALGVLQENGVYACFLYLLAREKENGSVVVEEMLNVLNELGFGWGKPANNRPEAVLAHVSEKVTTDLERLLLAKETLEQMLIYARYGAKARE

SEQ ID NO: 8662 - protein, 310 aa, Anabaena variabilis ATCC 29413
MVKQISLNLDGIVKEITNVNPAFARHETFHPRYGWIKKGFDMAQVNPKIFLQEDAPVRLGVGKNMVSAIRYWCNAFKVLENDEPSEFGNLLLGEDGWDIFLEDPATLWLLHWNLLKPSCNAAAWYFTFNIFRENEFSQDDLFNALCTYRDSIAPRIAESSLKKDVSCILRMYVEQANTKVGITEESLDCPFTQLGIIHTAGDSRHFTFRVGYKGNLPAEILVAACLEYASFVGREQRTISISRLVYDIGSPGMIFKLSESAVCDAIEQVARWSTSISLSDSSGLIQFSFTSEPEALAKDILDKYYKHRVS

SEQ ID NO: 8663 - protein, 318 aa, Shewanella frigidimarina NCIMB 400
MKAKFTGHDTFPLRYGWLFKAVNHLNSNGKFSSSDEDSIRQSIVELGVGKNMVKAIQYWAEASNVIHSERSNNSFTHAVSQNGEYLFGGESLEDGRDPYLELPGSIWLVHFWLNFNVEHLTAYRYFFNFANVQHFEKTKLIADCFEDAKKLVDSELGNISTIKKDIDCFLNTYSKKLKATPSKKSINIDEDHFISPLSELNLIQDNGGGFYISNLSERPELPIEIFTYALLEFFKTETVDSKVSTVDFDSLLSKPCSPGRIFRLSESGLGQKLDEVQNFTDKNISWVDSLGLRQVNVSDYAKTNSTLYLNQYYGTKND

SEQ ID NO: 8664 - protein, 307 aa, Polaromonas naphthalenivorans CJ2
MMGKNTIQARTSAYFSGHETFPLRQMWLKKAFEESVGHIIPKSAFAGENAIAAFGVGKNMVAAIRHWALACDVMRDDDPTGYTVTKNAIAIFDDAGLDPYSEDLNTAWYAHWWLAGKGNRATTWHWLFNHVTLPVFSREELEAPLAEFARRLDPKRKLSPATLSRDIETCIRGYAPRFAGGSPEDYAESMLGELGLIYEEHRGHFAFRRGPKTTLSDGMFTYALLDFWESTAPGLSSLAFESIAYGEGSPGRVFKLDEDSVAERLFNLDDLTKGALSWTDTAGLRQVHRKTEKLSGLSEKMIAKAYD

SEQ ID NO: 8665 - protein, 311 aa, Methylibium petroleiphilum PM1
MIPIIPGLKPQFSGHETFPLRQLWLHKAVRAVEENGAASSPFGDEEAIVRFGVGKNMVTSIRFWATACRAIREEGDGYAPTGLGADIFGLDGFDPYCEQAATPWLMHWFLASTYDKTTTWYFLFNHVTQQVFEREAVVAALLGGFSELTQAVPTLKRISPATLKRDVECCIRSYVPRLGSESPEEMSEPLLGELGLIQQNAKGTFEFRRGPKRSLPDGIFAYALLEYWKRQAAGSVMAFDRVAHDYGSPGRVFKLDEGAVADRLMALEALTDGDIQWTEQAGIRQVTRTGRALANIDEAMTKVLRAAYGRR

SEQ ID NO: 8666 - protein, 298 aa, Flavobacterium johnsoniae UW101
MSELLTSPYNKLTLSGHETFHCRQLWLKKGYDFVNNGNKFTDVEAVVLLGVGKNMVASIYFWMKAFSLIDGEGKLTSLAHYIFSSEGKDPFLEDEATLWLLHYHLVNQGFSSIYDLIFNYLRREKIEFTKENFLLFVQRKANEIGFTQFNKKTAGTDFDVLTKMYIRTTDQVKDKEDTFSGLLADLNLIQEEKKQTSLYSIPNESRNNLPEEIILYTILDKQDFQNSVSLNMLFQDRNQAGSVFGITKNALMEKLESLANNPKYKKYGVTLSDHAGIKELQFVSKPDKFEILNHYYGN

SEQ ID NO: 8667 - protein, 312 aa, Sphingomonas wittichii RW1
MLTSARPHYRFSGHESFACRYAWLPKAYRALRNDPLIFSDEPRAMVELGLGKNMVRSLRFWVEVAGLAEADAERGRGLRTTAFGDALLGEEGADRYLEDRRTLWLLHWKLSSRDEGALFAWDFLFSRWPYPELTRTEALGAFMRESEKLGHDHSQVTLGQHLDVFLHSYLGARSGKTALEDSLDGPLVELELLQPVGERKGEGGRFEPVYSFRREPKGEITAALFDYCVIDFWQRNHPGENSLTLRDIAMAPGSPGQVFKLPEDDVRARLESRDHGYPAPYTYQPSAVQGLLFRTSATVSLEQVYAQELADA

SEQ ID NO: 8668 - protein, 186 aa, Alteromonas macleodii  Deep ecotype
MTAMQSFEKSKLIFDIERDAKVICDKEVKESTIKKDVDCFLHTYASKSLAKGKKNFVIGEEHFASPLIELGLIRDLGKGNYSSILDERPTLPTEIFSFALLRFVFEIKASETAGFDALLSDQCSPGKIFRLSERGLGVQLDNAVKQYPNLLEETDTQGMRQVRVLKTFDENETFQFILDDYYRGSK

SEQ ID NO: 8669 - protein, 307 aa, Thauera sp. MZ1T
MTTAAISPGYTPHFSGHETFTLRQMWLKKVFDQRTKANRIKKSVFTDDESIARFGVGKNMVGSMRHWALATNLISEGGPDDYVVSQRAQWMFSNDGFDPYSENPNTAWFVHWQLAGLATRSTTWFWLFNKVTAPTFTKTDLEKPLADFAFKFNIKRGISASTLARDIDTCVRSYAPRSGGSSPEDFAEPMLGELGLISEETKGVFTFRRGPKPTLSNGLFIYALIDYWELLDPSASSMGFESVVYGEGSPGRVFKLDEESVAERLFSLEEDTAGALSWTDTSGLRQVLRKSWNSSAFQDSMLKKAYE

SEQ ID NO: 8670 - protein, 298 aa, Methylobacterium nodulans ORS 2060
MNQTLKPIRMEFGRHETFTIRHGWLGKGLERLGSPEGFAADTATADKLGLGSRMVRSLAYWLEASGLADVVMEGRSRRLNMSDIGRVIDANDAYVEYPGTLWFLQLAIASRDGSAPAWFFNDYLERSFERAACVEAFLRYAKQRATKTPTLQSTQRDVANVLASYAYNPTEAQDPEDGTICPLIELRLVTYHRDTRRFEKVRPVDPVPIEAVLAAASSCSNGEETLSVMDLASRRHGPGRLFGLSPEMIDRAAQEGARIYAKSGVTYVLLGAERRLSVPNRPPAWWLERHYRRIERQA

SEQ ID NO: 8671 - protein, 372 aa, Actinosynnema mirum DSM 43827
MADTRLAAAAHSSFARHETFAPRFGWLHKAYMRVKDNPGTFIAEDAPVELGVGKNMVNAMRYWSKTFKLTREHLSEDGKTKAHIASPTWEARWLLDEDGADPYLEDPGSLWLLHWWLVSSRPGAKCWAPTWYTAFHLAPFSRFSVVEMTQVVMRHVNFSFPEGPVEASVTKDVDCLTKMYARTPAEQPAARTTDTKTGAKSNFEDLLACPFRELDLLTPVGSRGNQQWQFTTGTRNSLPASVLVYACLDYAARDTSSSGSISLARLANEPGGPGRAFRVREPEIVAALDKVAAERADVSRVDAVGQRSMSFSGDPFVLAWDVLDEQYGYVTHRPGFPTRREWDQKYPMLAKVAMAESQQQKHQPLALMEEIA

SEQ ID NO: 8672 - protein, 101 aa, Mesoplasma florum L1
MEKFCPLEYTLNFIKSKWVILIIRELSFGTCRFNELEKRIAGISQKVLTSNLRFLEENKLVERTVYPVVPPKVEYSLTDLGKSLKPILDQMSDWGVKNYGK

SEQ ID NO: 8673 - protein, 160 aa, Burkholderia 383
MWNARVRARVPQERTGLCPSHIDVPATMPRPSDNDCQATRQILDRIGDKWSLYIIATLSDGSRRFNELKREIDGISQRMLTLTLRGLERDGLVTRTVFPTIPPRVDYALTPLGATLLEPVMALVMWAEKNKQPIAQARERFDDAADAAPEPGVGVVYRSR

SEQ ID NO: 8674 - protein, 150 aa, Rhodopseudomonas palustris BisB18
MTAKTAQEGTVLKLEHSDLPGHSDVTAPQASIHNDCRGVATVLSRVGDKWSVLVIMMLGERPLRFNELKRMIGGISQRMLTLTLRGLERDGLVTRTVFPTVPPRVDYELTELGRGLSAPVKELGQWAKQHLPDIEGARESFDRRRSAEQA

SEQ ID NO: 8675 - protein, 122 aa, Paracoccus denitrificans PD1222
MHDPNSFGCRAFTAVLQRIGDKWSLLIVSVLAEGPKRFNELRREIPSISQRMLTLTLRGLERDGLVSRTVTPSIPPRVDYELTELGQSLRKPVCALAEWAMANIDAIHTAQSRFDRANGEKV

SEQ ID NO: 8676 - protein, 124 aa, Sphingomonas wittichii RW1
MDMTSSVLAHGECMRVSGLLARIGDRWTLPVIVTLHDGPLRFNQVRRAVGGISQQMLTRTLRTLERDGMVGRTVHPTVPPQVEYALTPLGRSLAAEGLRLGGWVRDHIAEIDGHRSAFDRRQEG

SEQ ID NO: 8677 - protein, 135 aa, Methylobacterium extorquens PA1
MEPGHIEGTDAPPRPEHSGQDCRLVGTVLARIGDKWSVLVVMMLGDGPRRFNELKRMIGGISQRMLTFTLRGLERDGLVTRTIFPTIPPRVDYELTELGRSLREPIQALGAWAFAHLPEIQEARARFDRRSGEGA

SEQ ID NO: 8678 - protein, 135 aa, Methylobacterium populi BJ001
MEPGHIEGTEAAPKHAHSGQDCRLVGTVLARIGDKWSVLVVMMLADGPRRFNELKRMIGGISQRMLTFTLRGLERDGLVTRTIFPTIPPRVDYELTELGRSLREPIQALGAWAFAHLPEIQEARARFDRREGEKP

SEQ ID NO: 8679 - protein, 130 aa, Gluconacetobacter diazotrophicus PAl 5 JGI
MIRGNMHVTGEAPDPGQGNCRKISPVLARLGDKWSVLIVMQLGNGPRRFNEIRRMVDGISQRMLTLTLRGLERDGMVTRTVYPTIPPRVDYELTPLGRSLREPVQALGTWAMANLDKIEMAQREFDSRKA

SEQ ID NO: 8680 - protein, 135 aa, Methylocella silvestris BL2
MEPSHAHVPSQCGRVAPILARIGDKWSILVIMILGDGPMRFNELRRRIGGVSQRMLTFTLRGLERDGYLTRTVFPTVPPRVDYELTPLGQSLRAPVQALGNWAQQHLVTIEDARLRFDEAAKREPPAPPPLRFSP

SEQ ID NO: 8681 - protein, 135 aa, Methylobacterium chloromethanicum CM4
MEPGHIEGTDAPPRPEHSGQDCRLVGTVLARIGDKWSVLVVMMLGDGPRRFNELKRMIGGISQRMLTFTLRGLERDGLVTRTIFPTIPPRVDYELTELGRSLREPIQALGAWAFAHLPEIQEARARFDRRGGEGA

SEQ ID NO: 8682 - protein, 159 aa, Agrobacterium vitis S4
MVTANRAQGGTDLELGHINVTTSEPTAAPEVSMAAVNQRSSCEAVNSVLTRIGDKWSVLIVMMLANGPQRFNELKRRIGSISQRMLTLTLRGLERDGLVKRTVFPTIPPRVDYELTDLGQSLRQPIEALGHWAFDNYACIAKARDSFDKAAKKQGVRKP

SEQ ID NO: 8683 - protein, 132 aa, Catenulispora acidiphila DSM 44928
MAEARLEMPATCQEVGPEGQFVRGVLDRIGDKWSLMIIGSLNRGPRRFGALQAAIGGISQRMLTLNLRQLERDGLISRTVYAEVPPRVEYELTELGHGLLVPVLELVNWAGDHAEVIEKHRAAYDAGGGAVG

SEQ ID NO: 8684 - protein, 294 aa, Thermobifida fusca YX
MQLGMIGLGKMGGNMAARLRDKGHEVIGYDVNPELRDVDSIAELVERLSAPRTVWLMVPAGEPTRNTIRELADLLDEGDLVIEGGNSHYRDDRVHADELARRGIEYLDAGVSGGIWGRENGYGIMVGGSAENVARAKPIFDALTPEAGSGFVHAGEIGAGHFVKMVHNGIEYGMMQAFAEGYELMAASGIVKDVPGTLASWRQGTVVRSWLLDLLVRALEEDPELEQLRGYAEDSGEGRWTVQAAVDHAVPAPVITAALYARFASRQEDSPAMKVIAALRNQFGGHAVVKKNTD

SEQ ID NO: 8685 - protein, 297 aa, Mycobacterium MCS
MQLGLVGLGKMGFNMRERLREGGHEVVGFDPRPEVTDVPSLAALADALAPPRVVWVMVPSGPVTHDTIVSLAEVLGEGDLVIDGGNSRFTEDAPHAELLKAKGIGFIDAGVSGGVWGLAEGYGLMVGGDDADIERVMPIFDTLRPPGDRADGFVHAGPVGAGHFAKMVHNGVEYALMTAYGEGYELLAAEELIRDPQAVYQAWTNGTVVRSWLQQLLAKALREDPGLAEISGYTEDSGEGRWTVEEAIRLRVPVPSIAASLFARFESRQEDSPTMKAVSALRNQFGGHAVQRISKSG

SEQ ID NO: 8686 - protein, 294 aa, Arthrobacter FB24
MHIGLIGLGKMGFNMRERLRKGGLEVTGFDRNPDVTDVATVDELIAAVPAPRVIWVMVPAGEITDAVITELGSKLDAGDLVIDGGNSRFTEDQKHGAALAEKGIRFADCGVSGGVWGLQNGYGLMAGGDAADIERAMPAFDALRPEGDRADSFVHVGGIGAGHYAKMVHNGIEYGLMQAYAEGYELLAAKDIVTDLPGTFRAWQKGTVVRSWLLDLMVKALDEDPGLASIDDYVEDSGEGRWTVEEAIANAVPAPAITAALFARFSSREDNSPAMKMVSALRHQFGGHATRPAK

SEQ ID NO: 8687 - protein, 301 aa, Nocardioides JS614
MHIGLVGLGKMGGNMRTRLRDAGHTVVGFDRNPDLADVDSLEAMVEQLPSPKVVWVMVPAGDPTRETIRRLGELLDEGDLVVDGGNSKWTDDQENADLLAQRGVGFVDCGVSGGVWGAKFGYALMCGGSDEDVAKVQPAFDALKPDEGGFVHAGKKVGAGHFAKMVHNGIEYAMMQSYAEGWELLEKVDLVDNVTEVFDSWRSGTVIRSWLLDLLVTALEEDGHLDQITGYADDSGEGRWTVQAAIDNAVPMHVIAASLFARFTSRQDDSPAMKAVAAMRNQFGGHAVHTEPPVGGDANPG

SEQ ID NO: 8688 - protein, 297 aa, Mycobacterium KMS; identical to SEQ ID NO: 8685

SEQ ID NO: 8689 - protein, 297 aa, Mycobacterium vanbaalenii PYR-1
MQLGLIGLGKMGFNMRARLRDGGHDVVGFDPRPEVSDVASLADLAARLSAPRVVWVMVPSGTVTDSTISELAGVLSPGDLVIDGGNSRYTEDGRHANLLAEKGIAFIDAGVSGGIWGLTEGYGLMVGGSDADVARAMPIFETLRPPGPLEDGFVHVGPVGAGHFAKMVHNGIEYALMTAYAEGYEMLAAEDLVKDPQAVYQAWTNGTVVRSWLQQLLAKALKEDPSLSDISGYTEDSGEGRWTVEEAIRLRVPVPGIAASLFARFLSRQDESPTMKAVAALRNQFGGHAVKRVSESG

SEQ ID NO: 8690 - protein, 297 aa, Mycobacterium JLS
MQLGLVGLGKMGFNMRERLREGGHEVVGFDPRPEVTDVPSLAALADALAAPRVVWVMVPSGPVTHDTIVSLAEVLGEGDLVIDGGNSRFTEDAPHAELLKAKGIGFIDAGVSGGVWGLAEGYGLMVGGDDADIERVMPIFDTLRPPGDRADGFVHAGPVGAGHFAKMVHNGVEYALMTAYGEGYELLAAEELIRDPQAVYQAWTNGTVVRSWLQQLLAKALREDPGLAEISGYTEDSGEGRWTVEEAIRLRVPVPSIAASLFARFESRQEDSPTMKAVSALRNQFGGHAVQRISKSG

SEQ ID NO: 8691 - protein, 297 aa, Mycobacterium gilvum PYR-GCK
MQLGLIGLGKMGFNMRARLRDGGHDVVGYDPRPEVSDVESLEELAQRLDAPRVVWVMVPSGTVTDSTITELAEVLSEGDLVIDGGNSRYTEDQPHAKMLAQKGIGFVDAGVSGGIWGLTEGYGLMVGGSDADIARAMPIFDTLRPPGPQEDGFVHVGPVGAGHFAKMVHNGIEYALMTAYAEGYELLAAEELVKDPQAVYQAWTNGTVVRSWLQQLLAKALKEDPDLSEISGYTEDSGEGRWTVEEAIRLRVPVPGIAASLFARFLSRQDESPTMRAVAALRNQFGGHAVKRVSESG

SEQ ID NO: 8692 - protein, 290 aa, Salinispora tropica CNB-440
MQLGLVGLGRMGGNMRERLRAAGHEVIGYDNQAELSDVASLAEMAKKLDAPRAVWVMVPAAVTDETITKLAEVLDTGDIIVDGGNSRFSDDAPRAERLNERGIGYVDAGVSGGVWGRQNGYALMVGGAKEHVDRLMPIFEALKPAGEFGFVHAGPVGAGHYAKMVHNGVEYGLMHAYAEGYELLAKSELVTDVPGVFKSWREGTVVRSWLLDLLDRALDEDPKLAELSPYTEDTGEGRWTVDEAVRLAVPMNVIAAALFARFASRQDDSPAMKAVAALRQQFGGHAVRKR

SEQ ID NO: 8693 - protein, 290 aa, Salinispora arenicola CNS-205
MQLGLVGLGRMGGNMRERLRAAGHEVIGYDNRPELSDVANLGELAEKLDAPRAVWVMVPVGVTDDTIAKVADVLGTGDIIIDGGNSRFSDDAPRAERLDERGIGYVDVGVSGGVWGRQNGYGLMVGGAKDHVDRLMPIFEALKPAGEFGFVHAGPVGAGHYAKMVHNGVEYGLMHAYAEGYELLTKSELVTDVPGVVKSWREGTVVRSWLLDLLDRALDEDPELAELSDYTEDTGEGRWTVDEAVRLAVPMNVIAAALFARFASRQDESPAMKAVAALRQQFGGHAVRKR

SEQ ID NO: 8694 - protein, 294 aa, Arthrobacter chlorophenolicus A6
MHIGLIGLGKMGFNMRERLRNGGIEVTGYDRNPDVTDVATVDDLLAAVPAPRLIWVMVPAGAVTDAVITELAGKLDQGDLVIDGGNSRFTEDQKHGELLAGKGIRFVDCGVSGGVWGLQNGYGLMAGGDAADVDLALPVFDALRPEGDRADSFVHVGGVGAGHYAKMVHNGIEYGLMQAYAEGYQLLASKDIISDLPGTFRAWQKGTVVRSWLLDLLVKALEEDPGLQNIDDYVEDSGEGRWTVEEAIANAIPAPAITAALFARFESREDSSPAMKMVSALRHQFGGHATRPAK

SEQ ID NO: 8695 - protein, 304 aa, Actinosynnema mirum DSM 43827
MQLGIVGLGKMGFNMRERVRRAGHEVVGYDRNPDVSDTTSLADLAAKLTGPRVVWVMVPAGEITRNTVAELSEVLSEGDLVIDGGNSRFTDDALNAAKLAEKGIGYLDCGVSGGVWGLENGYGLMVGGDAADVERAMPIFDALRPEGPREEGFAHAGKLGAGHFAKMVHNGIEYGLMQAYAEGFELLEASELVENVPATIKAWQRGTVVRSWLLDLLVNALDSDPELDDLRGYVEDSGEGRWTVEEAINHAVPAPVISAALFARFASRQSDSPAMRAVAALRNQFGGHAVQSAGPSSGSGSTQG

SEQ ID NO: 8696 - protein, 297 aa, Beutenbergia cavernae DSM 12333
MHIGLVGIGRMGANMQERLREHGHEVTGYDQDPGVSDVASLEQLVAALPAPRVVWVMVPAGEITHAVIGDLRGLLAAGDLVIDGGNSNFREDKVHADDLAGHGIRYLDVGVSGGVWGRENGYGLMVGGAPDDVAEVMPVFDALRPEGDRDEGFVHVGPVGAGHYAKMVHNGIEYGLMQSYAEGYEILAARDDLVADVGGVFKAWQRGTVVRSWLLELMVRALEQDPDLEQISGWTADSGEGRWTVQEAVEHAVPAPVISAALFARFASRQEDSPAMKAVAALRQQFGGHATKPAADG

SEQ ID NO: 8697 - protein, 326 aa, Kytococcus sedentarius DSM 20547
MQLGLVGLGKMGGNMKTRLERAGHEVVGFDLDPQLRDVDSLQALVEALEGPRVVWVMVPHGKPTRNTIEELAKHLQPGDLVIEGGNSPYQDDFVHDELLSAKGIGYVDCGVSGGIWGLDNGYGLMCGGRPEHVEKAMPIFDALRPEGPREEGFVHAGEVGAGHYSKMVHNGIEYGLMAAYAEGYELLMAKEIVKDVPGAFKAWSRGTVVRSWLLDLLVDALEQNPGLKDVSGYTTDSGEGRWTVIEGVENAVPMPVISAALFSRFTSRQENSPAMQAVAALRGGFGGHEVMTFGDEPWDRPKQVHQAAEPADTQGEATPGAVDDEA

SEQ ID NO: 8698 - protein, 292 aa, Catenulispora acidiphila DSM 44928
MEIGLVGLGKMGGNMRERIRQAGHTVVGYDRDPKLADVGSLKELVQTLAAPRVIWIMVPAGEATDATVNELADLLHTGDMVIDGGNSRWTEDIKHAELLKAQGVAFVDAGVSGGVWGLQNGYALMVGGDEADIARVQPVFDALKPAGDSGFVHAGGVGAGHFSKMVHNGIEYGIMQSYAEGWELLEAAPNVTNVREVFRSWQEGTVIRSWLLDLLVRALDDDEHLAGIRGYADDSGEGRWTVEAGIDMAVPTPAITASLYARFTSRQEDSPQMKAIAALRNQFGGHAVKKES

SEQ ID NO: 8699 - protein, 297 aa, Saccharomonospora viridis DSM 43017
MAQLGLIGLGKMGFNMRERLREAGHRVVGYDRNAEVSDVASLADLVAALEAPRVVWVMVPAGAATRQTITELAELLDEGDLVIEGGNSRYTEDAEHAELLGRRGIGYLDVGVSGGVWGKENGYGLMVGGSTADVERAMPFFDALRPEGPREESFVHAGGVGAGHYAKMVHNGIEYGLMQAYAEGFELLEASGVVQDVPGVLKAWQRGTVVRSWLLELLVEALENDPELAELEAYVEDSGEGRWTLEEAIDNAVPAPVISAALFARFASRQENSPAMRAVAALRKQFGGHTVKTKVTD

SEQ ID NO: 8700 - protein, 301 aa, Nakamurella multipartita DSM 44233
MQLGLIGLGKMGANMAERLRRDGHQVVGFDRSPQAPRDVDSLEGLVAALTTTPRVVWVMVPSGEPTRATVAALGELLSPGDIIIDGGNSEYVDDKAHAAALAPKGIRYLDCGVSGGVWGITEGYALMVGGDADAVAVAQPIFDSLKPPTGGFVHAGPVGSGHFVKMIHNGIEYGIMQAYGEGYELMKAVDWVTNPDEVMASWQNGTVIRSWLLDLLVRALDADPGLSQIRGYAQDSGEGRWTIEAAIENAVPMPVITAALFARFASRQTDSPTMKVVAALRNQFGGHPVGTEGSDASVPIA

SEQ ID NO: 8701 - protein, 126 aa, Escherichia coli BL21 (DE3)
MSQVSLSQQLKEGNLFAEQCPSREVLKHVTSRWGVLILVALREGTHRFSDLRRKIGGVSEKMLAQSLQALEQDGFLNRIAYPVVPPHVEYSLTPLGEQVSEKVAALADWIELNLPEVLAVRDERAA

SEQ ID NO: 8702 - protein, 137 aa, Ralstonia solanacearum
MEATTAQAVELPRRPEHGTPPPESCRLVLEILSRIGDKWTVMVIGTLADGPMRFNAILRAISGISHRMLTLTLRGLEQDGLVKRTAYATIPPKVEYELTELGLSLIEPLRALGDWAVRNRPAIAAARAHFASLTATQ

SEQ ID NO: 8703 - protein, 142 aa, Pseudomonas syringae tomato DC3000
MSESASHPQSETVESMLAFVRQGQVLANDCPSRIVLNHVCSRWGVLVLVVLRGGMHRFSEVRRKIGGVSEKMLAQTLQHLEQDGFVSRKSLPVVPPHVQYRLTPMGEEVALQVETLATWIETNLPRIMQAREASNTAQTTPA

SEQ ID NO: 8704 - protein, 154 aa, Pseudomonas syringae pv B728a
MSESASQSSAPRSSVTPQGFQSEAVETLLALVRQGQVLATDCPSRVVLNHVCSRWGVLVLVVLRGGMHRFSEVRRKIGGVSEKMLAQTLQHLEHDGFVSRKSLPVVPPHVQYRLTPMGEEVALQVETLVTWIETNLPRIMQAREASNTLQTTPE

SEQ ID NO: 8705 - protein, 164 aa, Rhodopseudomonas palustris HaA2
MSRSPARNLHPLPPAPEPASDAAVLTERFSAWQAQGLDASRCPVRNVLDHLGSKWSTLLLIALAEKPVRFNALLRTVPDISRRMLTQTLRHLERDGLVARQVFPTKPPSVEYRLSAAGRSVLTPLTALVGWAESHFAEIEQARARFDAAEATAPVSSGETAYPL

SEQ ID NO: 8706 - protein, 128 aa, Rhodoferax ferrireducens T118
MAVHKSKVDWAERCPIRDVLERMGDRWSMLVLFTLGDHQSLRFSVLKTTIGDISQRMLSQTLRRLEQDGLVLRTAHATVPPRVDYELTALGQSFLLPMRNLLHWAEQNHQQVRDARVAYVPPPRHEAL

SEQ ID NO: 8707 - protein, 121 aa, Paracoccus denitrificans PD1222
MKKSDAAGRGDLMAAECPSRDVLRRLTGRWGMLVLRVLAEGPHRFSALRKRIGGVSERMLAQTLQGLEADGMVLRRDFQTVPPHVEYALTPLGHEAALRVGALLGWIEDALPQIARGWTRA

SEQ ID NO: 8708 - protein, 115 aa, Nocardioides JS614
MPFVRDLQLDTDCPDTRLLVEHVTSKWGVLVLLTLDDRTLRWSELKREIAGVSEKMLIQTLQVLEADGLVRRTALPVVPPHVEYSLTDDGRAAAAHLAPLVRWAQARVGPRVAVS

SEQ ID NO: 8709 - protein, 159 aa, Acidovorax avenae citrulli AAC00-1
MNLRATIPHSPEAGSGPSRPPPPASGVEASLPLAELMRRGDVLSPDCPAREILQHVTSRWGVLVLVALDDGTLRFSELRRKVGGVSERMLAQTLQVLERDGFVERRAYPVVPPHVEYRLTPLGRKVGLHVQALADWIGGHLPEILAARGQAAAAAVAGG

SEQ ID NO: 8710 - protein, 140 aa, Polaromonas naphthalenivorans CJ2
MNDVDLHAGEIATLADQLRRGSLFSVECPSREVLKHVTSRWGVLVLVALGGGTHRFSDLRRKVGGVSEKMLAQTLQCLESDGFVDRKSYPVVPPHVEYSLTPLGEEVARQVEALADWIEGNLPRIMDARRLQARSPFSKP

SEQ ID NO: 8711 - protein, 128 aa, Enterobacter sp. 638
MKSTLPTLSEQMRDGNLFAEQCPSRDVLKHVTSRWGVLILVALRQGTHRFSDLRRKMGGVSEKMLAQSLQALEQDGFVNRVSYPVVPPHVEYSLTPLGIEVSEKVAALADWIEVNTPQVLTNRDERAA

SEQ ID NO: 8712 - protein, 144 aa, Bradyrhizobium BTAi1
MKGTTSATAPSDVPAPAGGVRAWKEKFVSIEDCPIRTVINQIGDKWSVLILAVLGTRPHRFGELRREIDDISQRMLTQTLRDLQRDGLIARRVIPTVPPSVEYSVTALGQSLLEPMSRLIGWAEQHQAEIKRSRQRFDASVAPD

SEQ ID NO: 8713 - protein, 134 aa, Sinorhizobium medicae WSM419
MNKATAAVKGERVAVICGVPFDIDNCPVRDVMDNIGGKWNSLMILSLADGPLRFSQLRRLIPDISQRMLTQTLRDLQRDGYLNRTVYPTQPPSVEYSLTDLGHSFLPVLKVFVDWSLENHDAIRKARTAFDAPA

SEQ ID NO: 8714 - protein, 137 aa, Marinomonas MWYL1
MENNLQTSQNGMSRLFDKGDVFSDKCPSRDILKHVTSRWGVLVLFALKDGETQRFSELRRKISGVSEKMLAQTLQALELDGFVLRTSYPVVPPHVEYSLTDLGLEVSVRVASLADWIEDNITDILAIQSQRNEELAS

SEQ ID NO: 8715 - protein, 133 aa, Yersinia pseudotuberculosis IP 31758
MTKLQNMNGNISFPEQLRRGELLNVDCPSREILKRVTSRWGVLVLIALSNETLRFSALRRKIGGVSEKMLAQTLQHLEEDGFIDRTAYPVVPPHVEYSLTPLGKEIQEQVEGLTVWLETNLHRIMEQRQQRSV

SEQ ID NO: 8716 - protein, 121 aa, Xanthobacter autotrophicus Py2
MDQPYDVYQDRCPTRMVLDRLADKWALLILDRLRDGPVRFNHLRRDIAGISQKVLSQTLKKLERDGLISRQVFPTVPVTVEYALTGLGRTLTDTVAALAHWAEANMDAVLAAQKAYDSIVR

SEQ ID NO: 8717 - protein, 126 aa, Escherichia coli HS; identical to SEQ ID NO: 8701

SEQ ID NO: 8718 - protein, 126 aa, Escherichia coli E24377A; identical to SEQ ID NO: 8701

SEQ ID NO: 8719 - protein, 148 aa, Frankia EAN1pec
MVSNQVSGLSSGQLSHEIGHEVSDQFGGLRALFADGFFPRGCPTRTVLDHVTSRWGILVLLTLAGRTLRWGELRRAIEGVSEKMLAQTLRTLEQDGLVHREALLVIPPHVEYSLTGLGDDLVTRLAPLVAWIARHADEIVTRATPSTP

SEQ ID NO: 8720 - protein, 133 aa, Yersinia pestis Angola; identical to SEQ ID NO: 8715

SEQ ID NO: 8721 - protein, 163 aa, Methylobacterium extorquens PA1
MGQGDSDGTALRPGQTELARRFAVWQSSFAEISSCPVRDVLDRVGDKWSMLILIALAAGPGRFSAVARMIPDISKRMLTQTFRDLERDGLIARTVFPTKPPSVEYRLTPLGSALLDPLAHLVGWAEQNHAAIQEARKRFEAGSVQDGKQDAFASRSSADVSAD

SEQ ID NO: 8722 - protein, 126 aa, Escherichia coli C ATCC 8739; identical to SEQ ID NO: 8701

SEQ ID NO: 8723 - protein, 135 aa, Yersinia pseudotuberculosis YPIII
MRVTKLQNMNGNISFPEQLRRGELLNVDCPSREILKRVTSRWGVLVLIALSNETLRFSALRRKIGGVSEKMLAQTLQHLEEDGFIDRTAYPVVPPHVEYSLTPLGKEIQEQVEGLTVWLETNLHRIMEQRQQRSV

SEQ ID NO: 8724 - protein, 144 aa, Xylella fastidiosa M12
MNMFASIASSAPPPGWENLPFDATKCPVRDVLDHIGDKWSLLILLTLVPGPTRFSAIQRAVPDISKRMLTQTLRHLERNGMIGRTVYPTKPPRVKYALTPLGESLLVPVMHLLKWASTHYDEVLSARDRFDHAQQGGLAIACRI

SEQ ID NO: 8725 - protein, 126 aa, Escherichia coli SMS 3 5
MSQVSLSQQLKEGNLFAEQCPSREVLKHVTSRWGVLILVALREGTHRFSDLRRKMGGVSEKMLAQSLQALEQDGFLNRIAYPVVPPHVEYSLTPLGEQVSEKVAALADWIELNLPEVLAVRDERAA

SEQ ID NO: 8726 - protein, 146 aa, Leptothrix cholodnii SP 6
MTDRTSSEVAALPLSALVRRGELFSPDCPSRDVLKHVTSRWGVLLLVALMGGTHRFSDLRRKVGGVSEKMLAQTLRWLEADGFVLRVSHDTVPPHVEYSLTPLGLAVGQRVAALADWIELNLPDILDAQRLQVGASAAAAGRPPGR

SEQ ID NO: 8727 - protein, 144 aa, Methylobacterium radiotolerans JCM 2831
MGPGYAKETALPPARAELAAKYAVWQAGTLDPAACPVRDVLDRVGDKWSMLLLIALADGPLRFSALLRTLPDISKRMLTQTLRDLERDGFVARTVFPTKPPSVEYRLTDLGVALLEPLARLVRWAEESHGAIQAARTRFDAAPS

SEQ ID NO: 8728 - protein, 135 aa, Methylobacterium radiotolerans JCM 2831
MSDVSGLAGKFDSWQRMSFDPARCPVRDVLDHLGDKWTTLIVIALAGGPRRFGELNRSIPDISKRMLTQCLRNLERDGLITRHVFPTSPPSVEYRLADLGRSLLAPLQALVEWAEASHQSVRDARLRFDGVPSNT

SEQ ID NO: 8729 - protein, 144 aa, Xylella fastidiosa M23
MNMFASIASSAPPPGWENLPFDATKCQVRDVLDHIGDKWSLLILLTLVPGPTRFSAIQRAVPDISKRMLTQTLRHLERNGMIGRTVYPTKPPRVEYALAPLGESLLVPVMHLLKWASTHHDEVRSARDRFDHAQQGGLAIASRI

SEQ ID NO: 8730 - protein, 120 aa, Xanthomonas oryzae PXO99A
MRDVLDQIGDKWTLLILLTLIPGPSRFSAIQRAVPDISKRMLTQTLRNLERNGMITRKVYATKPPSVEYALSKLGIALLGPVSQLLNWAGEHHADIRAARERFDRAQQTVVTLDRDEAMA

SEQ ID NO: 8731 - protein, 126 aa, Shigella boydii CDC 3083 94; identical to SEQ ID NO: 8701

SEQ ID NO: 8732 - protein, 170 aa, Rhodopseudomonas palustris TIE 1
MTRSPGENLSVAAHRATLTDRYAAWREQGFDANRCPVRNVLDHLGSKWSTLLLIALAEKPMRFNALLRDVPDISKRMLTQTLRDLERDGLVARQVFPTKPPSVEYRLSASGESVLAPLTALVAWAEQHFPEIERARARFDSAARDGEPQVPGDSARPESPLALAPLPVRG

SEQ ID NO: 8733 - protein, 133 aa, Geobacter bemidjiensis Bem
MIESEVVTLSDQLRRGELLSTQCPSREILKHVTSQWGVLVLVALMEGTHRFSELRRKVGGVSEKMLAQTLQYLERDGFVDRISYPVVPPHVEYSLTPLGRAIGEKVEALADWIESNLPAIMVLKRTVHPGADR

SEQ ID NO: 8734 - protein, 157 aa, Methylobacterium sp. 4-46
MSARADLARAFAGWRRAAQDPASQDPASQDPASQDPASPDPASCPVRDVLDRVGDKWTSLILIALAEGPRRFGALGRAVPDISKRMLTQTLRHLERDGLATRTVFPTKPPSVEYRLTPLGESLLEPLAGLVAWAEERHAAIRAARARFDAGDDAGAG

SEQ ID NO: 8735 - protein, 126 aa, Escherichia coli O157 H7 EC4115; identical to SEQ ID NO: 8701

SEQ ID NO: 8736 - protein, 138 aa, Rhizobium leguminosarum bv  trifolii WSM2304
MSGAVVSLKNRMPGARREIDLAGLDFSNCPVRDMMQQIGGKWSTLLLEVLAAEPRRFGELRRMLPDISQRMLTQTLRDLQRDGYIAREVFPTKPPSVEYSMTELGRSLYLPLSQLLNWAEANHDAVRAARSRFDSADS

SEQ ID NO: 8737 - protein, 135 aa, Rhizobium leguminosarum bv  trifolii WSM2304
MNKIVGKIDGEQVIVVMGQVFTRSDCPVRDVLDNIGGKWNTLMILALAEGPMRFSALRRLIPDISQRMLTQTLRDLQRDGYIDRTVFPTQPPSVEYRLTSLGQSFLGLVKQLAGWSAENHAAIRTARTAYDAREL

SEQ ID NO: 8738 - protein, 163 aa, Methylobacterium chloromethanicum CM4
MGQGDSDGTALRPGQIELARRFAVWQSSFTEIASCPVRDVLDRVGDKWSMLILIALAAGPGRFSAVARMIPDISKRMLTQTFRDLERDGLIARTVFPTKPPSVEYRLTPLGSALLDPLAHLVGWAEQNHAAIQEARKRFEAGSVPDGKPDAFAPRSSADLSAD

SEQ ID NO: 8739 - protein, 125 aa, Arthrobacter chlorophenolicus A6
MDATLQPVPLPPSFSDGVFPAGCPSRTLLDHVTSKWGVLILTALSEGSQRWSELRRRAEGISEKMLAQTLKTLERDGLVSRDAQPVIPPRVDYSLTERGYELSALLVPLVAWTFDNAEEIINGRA

SEQ ID NO: 8740 - protein, 144 aa, Anaeromyxobacter dehalogenans 2CP 1
MARTGRGGRLAEALRSQAGRGDLHAPACPSRGVLDHVTSRWGVLVLVSLLEGTHRFSALRRKVAGVSEKMLSQTLQALEHDGFVRREVHPVIPPRVDYSLTSLGREVAGHVEALTDWIEDSLPRILAAREEPKSRPAPAGRARA

SEQ ID NO: 8741 - protein, 136 aa, Agrobacterium vitis S4
MNDATQRAPSEAMTRGVSKSKRAEDNCPVRSVISHVGDKWSTLILGSLAEKPYRFGELRRLVPDISQRMLTQTLRDLQRDGYVHRQVFPTKPPSVEYGLTEMGEQLVFSLKYLVEFAIDNHARVVEARARFDRQNV

SEQ ID NO: 8742 - protein, 128 aa, Actinosynnema mirum DSM 43827
MDGMATTGDVYDRNCPSRQIASHATSQWGGLVLGKLLEGKLRFSELRRAVVGVSEKMLAQTLQALERDGLVLREVHPVIPPHVDYSLTPAGAQLAARVRGLYDWIEDNLPDLCAARDAYDAKRAGTTV

SEQ ID NO: 8743 - protein, 138 aa, Rhizobium leguminosarum bv  trifolii WSM1325
MSGAVLSLKNRMPGTRREIDLAGLDFGNCPVRDMMQQIGGKWSTLLLDVLADRPYRFGELRRMIPDISQRMLTQTLRDLQRDGYIHREVFPTKPPSVEYSMTELGRSLYQTLAQLLNWAEANHDAVRAARSQFDSHNS

SEQ ID NO: 8744 - protein, 144 aa, Pectobacterium carotovorum PC1
MSQSKTPIDLLPPLLPTGDVFAEKCPSRQILNHVTSRWGVLILIALLDDTHRFSQLRRRIGGVSERMLAQTLQWLESDGFVLRTAYPVVPPHVEYSLTPLGKEVGVRVKELAIWVEGNLDEIMAAQQSSEQRSDKQPSGKLRAS

SEQ ID NO: 8745 - protein, 124 aa, Chitinophaga pinensis DSM 2588
MTKEDWKKYSEADSECAVRNVLDRLGDKWSMLVIIVLGVEGTLRFNKLHSFIGDISQKMLTVTLKSLEADGLITRTVFPEIPPRVEYALTERGASLLPHMEALAEWAATHMEGIYASREKYVRS

SEQ ID NO: 8746 - protein, 153 aa, Catenulispora acidiphila DSM 44928
MSTRVVTPGVVTPEAEERALGMAYDVVYDVLQAPCPSRQALEHVTGRWGALIMMALREGPVRFNELRRRVDGVSEKMLSQGLQALERDGFVAREVQSTMPPKVEYQLTPLGTQTSDRLADLVEFLEGRMPEVEAAQARHDEAASAAASVSASA

SEQ ID NO: 8747 - protein, 88 aa, Clostridium perfringens SM101 uid12521
MKPKKIPMRMCNGCMEMKPKKELIRIVKNSEGEVSVDLTGKKSGRGAYICKSVECLEKAFKAKRLNKNLQSNIGDEVYDRLRDEITNG

SEQ ID NO: 8748 - protein, 98 aa, Streptococcus agalactiae 2603
MAKTKKIPLRKSVVSGEVIDKRDLLRIVKNKEGQVFIDPTGKQNGRGAYIKLDNDEAILAKKKRVFDRSFSMEVSDEFYDELLAYVDHKVKRRELGLE

SEQ ID NO: 8749 - protein, 90 aa, Bacillus cereus ATCC 10987
MSNRKVPLRKCVATQEMKSKRELVRIVRSKEGEVSIDLTGKKSGRGAYLSKDKESILQAQKKNVLEHHLKAKIDSSLYEELLELVEKESK

SEQ ID NO: 8750 - protein, 94 aa, Listeria monocytogenes 4b F2365
MRNKKIPLRKCIITGERLPKGELLRIAYSKDGALTIDPTGKAPGRGFYIIKSVEVCEKAKKKNAIFHQLKMPEQESFYDELITYVKSLEEPTNG

SEQ ID NO: 8751 - protein, 90 aa, Bacillus anthracis Ames 0581; identical to SEQ ID NO: 8749

SEQ ID NO: 8752 - protein, 93 aa, Bacillus anthracis str Sterne
MMSMSNRKVPLRKCVATQEMKSKRELVRIVRSKEGEVSIDLTGKKSGRGAYLSKDKESILQAQKKNVLEHHLKAKIDSSLYEELLELVEKESK

SEQ ID NO: 8753 - protein, 93 aa, Bacillus thuringiensis konkukian; identical to SEQ ID NO: 8752

SEQ ID NO: 8754 - protein, 103 aa, Mesoplasma florum L1
MMKMKKILKKTNTKIYMIKNNLRKDVVSKEMLDKSALIRVVLNKNNEIFIDLTYKADGRGVYVKNDLNSVKIAKQKNLLSRGLKTKVDLSIYDELEKLFNEQN

SEQ ID NO: 8755 - protein, 93 aa, Bacillus cereus ZK; identical to SEQ ID NO: 8752

SEQ ID NO: 8756 - protein, 104 aa, Dehalococcoides ethenogenes 195
MNQRKSTSKFVPMRTCIACRTEKAKQELIRLVRTEDNDVRVDHSGRLEGRGAYLCRDMACWESGLKGSYITHALKIAITPENREELLKYGREVCEVKENGREDK

SEQ ID NO: 8757 - protein, 94 aa, Staphylococcus aureus COL
MKKKKIPMRKCILSNEMHPKKDMIRVVVNKEGEIFADVTGKKQGRGAYVSKDVAMVEKAQQKEILEKYFKASKEQLDPVYKEIIRLIYREEIPK

SEQ ID NO: 8758 - protein, 94 aa, Staphylococcus epidermidis RP62A
MRKKKIPMRKCIISNEMRPKKDMIRVVINKEGEIFADATGKKQGRGAYVSKDVALVEKAQQREVLEKYFNATKDTLDPVYKEIIRLIYREEIPK

SEQ ID NO: 8759 - protein, 91 aa, Prochlorococcus marinus NATL2A
MSQNPILRRCIACKKVLDRKYFLKVTRDFQNGVVFSGGMGRSAYLCPTESCFEEALKRKRLQKSLRCDIHSSVFNMLQKQLNTCIDSDTEA

SEQ ID NO: 8760 - protein, 89 aa, Anabaena variabilis ATCC 29413
MQPNYRRCISCRKVGLKQDFWRIVRVFPSGKVQLNEGMGRSAYICPQMSCLQAAQKKNRLGRSLQASVPDTLYQKLWQNLAQNDPQNQN

SEQ ID NO: 8761 - protein, 92 aa, Synechococcus sp. CC9902
MSAKPILRRCVACRQLQDRRHLWRVIRDHKDGVLLDFGMGRSAYLCPKEECLEEARRRKRLQKALRCQVPDAVLTTLNGRLSASTGESAEAN

SEQ ID NO: 8762 - protein, 92 aa, Synechococcus sp. CC9605
MSDRPVLRRCVACRQLLDRRQLWRVIRDHQDGVRLDEGMGRSAYLCREENCLQEATRRKRLQKALRCQVPETVLAVLKQRLNQSVGESAEAD

SEQ ID NO: 8763 - protein, 93 aa, Prochlorococcus marinus MIT 9312
MIQQRPVLRICISCRKTYDRKNLLKITKDHKQGIMFHKGMGRSAYICKSNKCYSDSKIKKKLQKALKTFLEPQFIEIFEKEITSYNDYPIEGI

SEQ ID NO: 8764 - protein, 97 aa, Synechococcus elongatus PCC 7942
MSRLPQGYRRCIACRRLAHRQEFWRVIRLASTGAIALDQGEGRSAYLCPTVACFNQGRRKNRLGRALRSAIPDSVWVALEARLSVTICPSLSEGSDG

SEQ ID NO: 8765 - protein, 93 aa, Deinococcus geothermalis DSM 11300
MPAPTPRPHTQRHCPERTCVACRRKRPQGELVRVTRTAEGWRVLRGSRAGRGAYVCADSPECWQEKRLRRAFRGDAPVVSAQLYTLNIPMDQL

SEQ ID NO: 8766 - protein, 93 aa, Moorella thermoacetica ATCC 39073
MPKPRKIPVRMCVGCRARNDKRNLLRVVRTPEQEVVIDPTGKRAGRGAYLCPRVECLRKAVKSRALERALGVAVSPEVLERLEASFNQEGNHE

SEQ ID NO: 8767 - protein, 84 aa, Trichodesmium erythraeum IMS101
MKPNYRRCVSCKKLAPKEEFWRVVRSKKSDTIKLDQGEGRSAYICCGQIECLKIAHKKNKLGRSLKAYVSPEIYQSLWQRLESL

SEQ ID NO: 8768 - protein, 88 aa, Clostridium perfringens ATCC 13124
MKPKKIPMRMCNGCMEMKPKKELIRIVKNAEGEVSVDLTGKKSGRGAYICKSVECLEKAFKAKRLNKNLQSNIGDEVYDRLRDEITNG

SEQ ID NO: 8769 - protein, 93 aa, Syntrophomonas wolfei Goettingen
MSRIRKQPQRMCVGCREMKNKRELVRIVRSPQGDIDLDTTGKKPGRGAYICPEPECLKQAIKGKRLQKALEQNIPEGVLEKIREQIEQDKTGQ

SEQ ID NO: 8770 - protein, 113 aa, Oenococcus oeni PSU-1
MAKKKRQFKARKIPMRKDIVSGQMFPKKDLIRIVKTPSGELELDPTGRANGRGAYVSVDVTLAKKAKIEKSLDSTFEMTVADVFYDKLIDFVKHQQDRKELFSHEQIIKAENS

SEQ ID NO: 8771 - protein, 91 aa, Leuconostoc mesenteroides ATCC 8293
MRKDIVTGEMFPKKELVRVVRSKEGDVALDPTGKANGRGAYVSLNVKNAEMAKEKRIFDKAFGVKVADEFYDELIAYVDHQQARRELFGDK

SEQ ID NO: 8772 - protein, 98 aa, Lactobacillus gasseri ATCC 33323
MKKRKIPMRKDLLTNTMQPKKELVRVVVDKDKNISVDPTGKKSGRGAYVSLEPDKIAEAKKNQVLEKSLGVKVSADFYDDLYAYVDHQKARKELFGDK

SEQ ID NO: 8773 - protein, 108 aa, Lactococcus lactis cremoris SK11
MKQKKIPMRKSLVSNEQFPKRDLLRIAYNKEGEISIDPSGKAHGRGAYIAILNKEAKEAKKKRVFDRAFQTKIADEFYDELITYVEHLVARRELESTTYSADLAPDYD

SEQ ID NO: 8774 - protein, 98 aa, Streptococcus thermophilus LMD-9
MAKTRKIPLRKSVVSGEIIDKRDLLRIVKTKDGEIFIDPTGKKNGRGAYIKLDNEEALQAKKKQVFNHSFSMDVPESFYDELIAYVDHKVKRRELGLE

SEQ ID NO: 8775 - protein, 76 aa, Desulfovibrio vulgaris DP4
MTPSEERHQPIRMCVICRRRFAKHELLRYVCPAEGAAPVADERQVLPGRGWYVCGDPACRERLRKFGGWRRKRKGV

SEQ ID NO: 8776 - protein, 63 aa, Prochlorococcus marinus MIT 9515
MRITKDHKLGIMLNQGMGRSAYVCKSKKCYTDSKLQKKLQKALKSVLNPDFFDIFEREIANYQ

SEQ ID NO: 8777 - protein, 90 aa, Prochlorococcus marinus AS9601
MIQEIPVMRLCISCRKTYDRKDLLKITKDHKQGIMLQKGMGRSAYICKSKKCYSDSKIKKKLQKALKTFLEPEFIEIFEKEITSYINYPH

SEQ ID NO: 8778 - protein, 92 aa, Prochlorococcus marinus MIT 9303
MNQRPVLRSCVTCRQLLDRQQLWRVIRDHQEGVVLDEGMGRSAYLCPNEACLEEALRRKRLQKALRCQVPNSVVEVLQKRLNHSFDSAAEAK

SEQ ID NO: 8779 - protein, 91 aa, Prochlorococcus marinus NATL1A
MSQPPILRRCVACKKVLDRKYFLKVTRDFQNGVVFSGGMGRSAYLCPTESCFQEALKRKRLQKSLRCDIHSSVFNMLQKQLNTCIDSDTEA

SEQ ID NO: 8780 - protein, 92 aa, Clostridium thermocellum ATCC 27405
MKQKKIPMRMCLGCQEMKPKKELIRVVKNKENEISLDFTGKKPGRGAYICKNVSCFEKAKKGRKFERAFETSIGEEIYELLRKELEEGHAGE

SEQ ID NO: 8781 - protein, 90 aa, Prochlorococcus marinus MIT 9301
MIQQNPVLRMCISCRKTYDRKDLLKITKDHKQGIILQKGMGRSAYICKSKKCYSDSKIKKKLQKALKTFLEPEFVEIFEKEITSYNNYPH

SEQ ID NO: 8782 - protein, 88 aa, Desulfotomaculum reducens MI-1
MPKVKKVPLRMCIGCQEMKPKRELTRVVRTPQETVEIDPTGKKSGRGAYVCPSANCLQKAIKGKRLERSLECAISPEIIENLKQGLVK

SEQ ID NO: 8783 - protein, 104 aa, Dehalococcoides BAV1
MNQRKLTSKFVPMRTCIACRTEKAKADLVRLVRTEDNDVRVDHSGRLEGRGAYLCRDMACWESGLKGSYITHALKIAITPENREELLKYGREVCEVKENGREDK

SEQ ID NO: 8784 - protein, 94 aa, Staphylococcus aureus JH9; identical to SEQ ID NO: 8757

SEQ ID NO: 8785 - protein, 100 aa, Lactobacillus reuteri DSM 20016
MKKRKIPMRKDIVTGEMMPKRQLIRVVKNKENEVSLDPTGKKPGRGAYVAVDVDIAKRAKKEKTFEKAFHVQLDESFYDELIKYADHLQARQELFGNDQK

SEQ ID NO: 8786 - protein, 118 aa, Roseiflexus sp. RS-1
MKGASRPDRSTAVTQTAKKKKGPRQKHVPQRTCVACRHTDAKRTLIRLVRDADARVHIDPTGKRNGRGAYLCNDPACWDQALRRHALERALRVSALHPDDLAALEAYARTLPSVTGVK

SEQ ID NO: 8787 - protein, 94 aa, Staphylococcus aureus JH1; identical to SEQ ID NO: 8757

SEQ ID NO: 8788 - protein, 93 aa, Bacillus cereus cytotoxis NVH 391-98
MMSMSNRKVPLRKCVVTQEMKPKRELVRIVRSKEGEVSIDLTGKKSGRGAYLSMDKECILQAQKKNILEHHLKAKIDSSLYEELLELVEKESK

SEQ ID NO: 8789 - protein, 104 aa, Roseiflexus castenholzii DSM 13941
MPKKKQKGPRPKHVPQRTCVVCRCTHAKRALIRLVRDADGRVHVDPTGKRNGRGAYLCHNSECWNQAIRRGALARALRIDALHPDDSAALEAYARALTPLTIAE

SEQ ID NO: 8790 - protein, 107 aa, Herpetosiphon aurantiacus ATCC 23779
MAAQKQSPRPRHVPQRMCVACRRTESKRQLVRLVRLADQSVVVDPSGKQAGRGAYLCAERPCWTNALKRGALERALRVELSAIDQQALQTIADQFPDAEPAVEAAMN

SEQ ID NO: 8791 - protein, 92 aa, Prochlorococcus marinus MIT 9211
MNQKTVLRRCVACRKLIDRQQLWRVTRDHQGGVVLDEGMGRSAYLCPNEACLEEALRRKRLQKALRCQVQMSILEVLQNRLNSCNDASSEAI

SEQ ID NO: 8792 - protein, 91 aa, Clostridium phytofermentans ISDg
MNTRKIPLRKCTGCGEMKSKKEMIRVLKTPEDTIVLDTTGKKNGRGAYICNSLECLRKAIKSKGLERSLKTAIPKEVYEQLESELSEIADE

SEQ ID NO: 8793 - protein, 90 aa, Bacillus weihenstephanensis KBAB4
MSNRKVPLRKCIATQEMKSKRELVRIVRSKEGEVSIDLSGKKSGRGAYLSKDKESIIQAQKKNILEHHLKAKIDSSLYEELLELVEKESK

SEQ ID NO: 8794 - protein, 90 aa, Thermoanaerobacter sp. X514
MKTKKVPMRMCLGCQQMKPKKELIRIVRRAKDSVVQVDLTGKVPGRGCYICKDINCLEKAFKNKRLEKALEVPISDEIYEQLKREIEDEE

SEQ ID NO: 8795 - protein, 92 aa, Candidatus Desulforudis audaxviator MP104C
MPAKKVPLRMCLGCREMRPKKELIRVVRTPAGTVEIDPTGKRPGRGAYVCGRESCVDQAVETRRLEKALKTGVLPETIQDLRREIERRAGGI

SEQ ID NO: 8796 - protein, 91 aa, Natranaerobius thermophilus JW NM WN LF
MARKKKIPVRTCLGCQEKQSKRELVRIVRTPESEIKLDPTGKANGRGTYVCPSEDCLEKALKKDKLKKALNTGVSEEEKEKIRTEWDQFQK

SEQ ID NO: 8797 - protein, 105 aa, Mycoplasma arthritidis 158L3 1
MKIDKLYLRKSITDGQYYPQDRLVRFAKSKDGIVEFDPNKNKKGRGAYCLKENEVIEEVLKKRLLNRAFKKTIEASQYEKLRDEVNIWQKTQIKEDQTLNTLKNN

SEQ ID NO: 8798 - protein, 90 aa, Bacillus cereus AH187; identical to SEQ ID NO: 8749

SEQ ID NO: 8799 - protein, 98 aa, Dictyoglomus turgidum DSM 6724
MSKGKHIPLRTCIGCGEKKPKRELLRIVRGENNSIFYDPTGKASGRGAYICPKIECLELAIKKRAFSHALKCEISKEDLERIREELEREITKRGEMVV

SEQ ID NO: 8800 - protein, 90 aa, Bacillus cereus B4264
MSNRKVPLRKCVATQEMKSKRELVRIVRSKEGEVSIDLTGKKSGRGAYLSKDKESILQAQKKNVLEHHLKAKIDGSLYEELLELVEKESK

SEQ ID NO: 8801 - protein, 84 aa, Cyanothece PCC 7424
MKPNYRRCVSCGQVALKDSFWRIVRVYPSRKLQLDYGMGRSAYLCPCASCLKEARQKNRLGRALRVPIPDYIYQALSERLTPTK

SEQ ID NO: 8802 - protein, 85 aa, Cyanothece PCC 8801
MKPNYRRCISCRKVAPKQAFWRIVRVYPSQEVQLDHGMGRSAYLCPEKSCLDNATKKNRLGRTLKASVPPTIYQSLWERLEELPP

SEQ ID NO: 8803 - protein, 90 aa, Bacillus cereus G9842
MSNRKVPLRKCIATQEMKSKRELVRIVRSKEGEVSIDLSGKKSGRGAYLSKDKECIIQAQKKNILEHHLKAKIDSSLYEELLELVEKESK

SEQ ID NO: 8804 - protein, 83 aa, Desulfovibrio vulgaris  Miyazaki F
MDEAIRGKHIPLRTCVICRRRFAKRELLRYVPPTDAAGAGADPVPDERQVLPGRGFYVCESPECRERFRKFGGWRRKRKGVQE

SEQ ID NO: 8805 - protein, 90 aa, Bacillus cereus AH820; identical to SEQ ID NO: 8749

SEQ ID NO: 8806 - protein, 89 aa, Desulfitobacterium hafniense DCB 2
MKTRKIPLRMCLGCQEMKPKKELIRVVRTPEGAVELDLTGKRNGRGAYICPDIECFKAAVKGKRFQKALEIELAPQVIEELERKLGREC

SEQ ID NO: 8807 - protein, 90 aa, Halothermothrix orenii H 168
MSRKVPVRMCIGCQTRKPKKELIRIIYNKKTGEIKVDPSGKLPGRGAYICPDKGCLKKAKKGNRLNKSLKTSISDEIYTKLMEEIDKMNG

SEQ ID NO: 8808 - protein, 90 aa, Clostridium cellulolyticum H10
MKQKKIPLRMCLGCKEMKPKRELIRVVKNNEGEISIDLVGKKPGRGAYICRSADCLEQAIKAKRLEKAFETTIDMDIYNILKNQLEENDE

SEQ ID NO: 8809 - protein, 81 aa, Desulfovibrio desulfuricans ATCC 27774
MGERQETAVAVEGPVRMCVMCRRRFAKAQLTRHVLTPQGILTIDAEKTRPGRGWYLCSDAACMAKFVRFRPGARRKGGKHV

SEQ ID NO: 8810 - protein, 84 aa, Cyanothece PCC 7425
MEPNYRRCVSCRHLAPKQDFWRIVRVYPSAEVCLDEGSGRSAYLCPQLSCLELAQKKNRLGRALKTSVPPVIYLQLRQRLSPLS

SEQ ID NO: 8811 - protein, 74 aa, Anaerocellum thermophilum DSM 6725
MSIKPKKELLRIVRTDKEIFIDSKQKMPGRGAYICKDLECLKLAMKKKGLEKSLKVNISKDFYEKLEEFLKNWQ

SEQ ID NO: 8812 - protein, 70 aa, Acidimicrobium ferrooxidans DSM 10331
MHVVEGRLAVGAGPGRGAWICPREACLERALAHGRLRRALRLAPSDGELVDEGVRQAWRAAIAGHGASSA

SEQ ID NO: 8813 - protein, 69 aa, Desulfomicrobium baculatum DSM 4028
MCVICRQRFSKDELYRFTCPVHGELTLTADSTGKTPGRGFYLCRDAACRNKFERFKGWQKKCKGVGHVH

SEQ ID NO: 8814 - protein, 96 aa, Geobacillus WCH70
MAGQKKVPLRKCVVTGEMKPKKEMMRIVRSKDGEVSIDPTGKKAGRGAYITLDKECILLAKKKNILAHHLKTEIPDALYDELLQLAEKETAAGNEQ

SEQ ID NO: 8815 - protein, 95 aa, Eggerthella lenta DSM 2243
MTTTRTVRQRSCIACGKLAGKAELMRIVRDPSGAVSFDKTGRAPGRGAYVCSEECFAAACKKKKLDRALKATLGSDEYDRIAADVASAAREARQK

SEQ ID NO: 8816 - protein, 108 aa, Chloroflexus aggregans DSM 9485
MAAKAQTGTPRPRHIPQRTCIVCRHSDAKRALIRLVRDAQGRVTIDPTGKRSGRGAYLCHNPECWTQALRRHAIERALKISMLHLDDRAAIEQMARQLLQATTSAVSE

SEQ ID NO: 8817 - protein, 105 aa, Cryptobacterium curtum DSM 15641
MMNAAATTRRSHEPPLRTRRCMTCSSKREKADLFRVVRHADGTVAFDPTGRAPGRGAYVCSPACLEEACRKGLMGRALKTRVDNRAAQQIVADMLREHERRAGID

SEQ ID NO: 8818 - protein, 88 aa, Anaerococcus prevotii DSM 20548
MKKAKKIPQRKCVVCGKLKDKKDLLRVVKNKDEGILIDESGKKNGRGAYICKDDACIEEAIRTNKLNRVFRTEVSDELYEELKAYEVN

SEQ ID NO: 8819 - protein, 85 aa, Cyanothece PCC 8802; identical to SEQ ID NO: 8802

SEQ ID NO: 8820 - protein, 89 aa, Desulfotomaculum acetoxidans DSM 771
MVPKVRKIPQRMCVGCQEMKPKKEMIRVVKTPENSIEIDPTGKRAGRGAYVCPSLECLQKAIKARRLEKALHHSVSPEIIDVLKQGLVK

SEQ ID NO: 8821 - protein, 93 aa, Alicyclobacillus acidocaldarius DSM 446
MNRVRKVPLRKCVGCQEMKPKAELTRVVRTPEGDIVLDSTGKRNGRGAYLCPSEACLNVAVKRKALERALKAAIPQEIHESLRRQLVGDGDAH

SEQ ID NO: 8822 - protein, 86 aa, Desulfohalobium retbaense DSM 5692
MQNQPVNHSRQHGHQPERMCVICRRRFAKHQLHRLVASADCDRLLDDPKQTRPGRGYYICPDPACQKRISKFRGWRKKCKGGRHDN

SEQ ID NO: 8823 - protein, 260 aa, Enterobacter sp. 638
MKPIDLQAENSTETVGRSLRRRPLARKKLSDMVEEELEQMIRRQEFAQGEQLPSERELMEFFNVGRPSVREALAALKRKGLVQINNGERARVSMPSADTIIGELSGMAKDFLTQPGGITHFEQLRLFFESSLVRYAAEFATDEQVESLSKALEINSQSLSDNALFIRSDVDFHRVLAEIPGNPIFMAIHVALLDWLIAARPKVSDAELYEHNNVSYRQHIAIVDAIRRHDPDEADRALQSHLNSVSATWHAFGQGSKKKK

SEQ ID NO: 8824 - protein, 260 aa, Shigella boydii CDC 3083 94
MNAFDSQTEDSSPAIGRNLRSRPLARKKLSEMVEEELEQMIRRREFGEGEQLPSERELMAFFNVGRPSVREALAALKRKGLVQINNGERARVSRPSADTIIGELSGMAKDFLSHPGGIAHFEQLRLFFESSLVRYAAEHATDEQIDLLAKALEINSQSLDNNAAFIRSDVDFHRVLAEIPGNPIFMAIHVALLDWLIAARPTVTDQALHEHNNVSYQQHIAIVDAIRRHDPDEADRALQSHLNSVSATWHAFGQTTNKKK

SEQ ID NO: 8825 - protein, 260 aa, Salmonella enterica serovar Newport SL254
MNAFDSQAEDSPTSLGRSLRRRPLARKKLSEMVEEELEQMIRRHEFGEGEQLPSERELMAFFNVGRPSVREALAALKRKGLVQINNGERARVSRPSADTIISELSGMAKDFLTHPGGIAHFEQLRLFFESSLVRYAAEHATDEQIALLAKALEINSQSLDDNALFIRSDVEFHRVLAEIPGNPIFMAIHVALLDWLIAARPSVPDRELHEHNNVSYQQHIVIVDAIRQRDPDKADRALQTHLNSVSATWHALGKKSQKMR

SEQ ID NO: 8826 - protein, 260 aa, Salmonella enterica serovar Heidelberg SL476
MNAFDSQAEDSPTSLGRSLRRRPLARKKLSEMVEEELEQMIRRHEFGEGEQLPSERELMAFFNVGRPSVREALAALKRKGLVQINNGERARVSRPSADTIISELSGMAKDFLTHPGGIAHFEQLRLFFESSLVRYAAEHATDEQIALLTKALEINSQSLDDNALFIRSDVEFHRVLAEIPGNPIFMAIHVALLDWLIAARPSVPDRELHEHNNVSYQQHIVIVDAIRQRDPDKADRALQTHLNSVSATWHALGKKSQKMR

SEQ ID NO: 8827 - protein, 242 aa, Salmonella enterica serovar Schwarzengrund CVM19633
MRRRPLARKKLSEMVEEELEQMIRRHEFGEGEQLPSERELMAFFNVGRPSVREALAALKRKGLVQINNGERARVSRPSADTIISELSGMAKDFLTHPGGIAHFEQLRLFFESSLVRYAAEHATDEQIALLTKALEINSQSLDDNALFIRSDVEFHRVLAEIPGNPIFMAIHVALLDWLIAARPSVPDRELHEHNNLSYQQHIVIVDAIRQRDPDKADRALQTHLNSVSATWHALGKKSQKMR

SEQ ID NO: 8828 - protein, 260 aa, Salmonella enterica serovar Agona SL483; identical to SEQ ID NO: 8826

SEQ ID NO: 8829 - protein, 260 aa, Salmonella enterica serovar Dublin CT 02021853; identical to SEQ ID NO: 8826

SEQ ID NO: 8830 - protein, 260 aa, Escherichia coli O157 H7 EC4115
MNAFDSQTEDSSPAIGRNLRSRPLARKKLSEMVEEELEQMIRRREFGEGEQLPSERELMAFFNVGRPSVREALAALKRKGLVQINNGERARVSRPSADTIIGELSGMAKDFLSHPGGIAHFEQLRLFFESSLVRYAAEHATDEQIDLLAKALEINSQSLDNNAAFIRSDVDFHRVLAEIPGNPIFMAIHVALLDWLIAARPTVADQALHEHNNVSYQQHIAIVDAIRRHDPDEADRALQSHLNSVSATWHAFGQTTNKKK

SEQ ID NO: 8831 - protein, 151 aa, Pseudoalteromonas atlantica T6c
MSFTGRDQTFTDTTITNNGFLPDVSIGDFQENYRVANEYGLGAVTESLELAMIEMNGRLKKRLAEWELAGYASLSDVPEQAIPNQYQTLYLAAVMHWAKSELIRRNISVTTRKVSDVTGTVAEPNEIWYRRRADQYARQLTGSTGITCVLL

SEQ ID NO: 8832 - protein, 153 aa, Shewanella sp. MR-7
MSGFGFKAPAEESIVIDAASGWPELSTGEFRELRRIPEFFSEKTIEDSLNRSVAEIQQQIINYVGQASTDTDVHFTLGASLAPNFSAQQISIYRGAVYARSHADLLGYFSAVDQKDAGNNKAQDVDQQQAILAQSNRAVRLLLGLGRAGVHAL

SEQ ID NO: 8833 - protein, 151 aa, Desulfovibrio vulgaris DP4
MSFNALTDKTSTRIVAGDGWWPDLSVGEFMGNYRLPAEYAEDMVEDHIAIARLWAVRQLAAWRAGQQAAGHASIDTVPVCGLAGEATRLFKRAVFCHAKALLLGQFVTVERREAARDAGKETPDITAMFYAWAHDAIADLLGNGRVSVGLV

SEQ ID NO: 8834 - protein, 153 aa, Shewanella baltica OS155
MSGFGFQAPAEPSIVIDAGSGWPELSTGEFREEHRIPEFFSEQTIADSLNRSVEEVQREIINFVGQASTDTDVPFTLSMGLVPNFNAKQISIYRGAVYCRSHSDLLGHFSAVDQKEAGNNKAQDTKQQDAILAQSNRAVRLLLGLGRAGVHSL

SEQ ID NO: 8835 - protein, 153 aa, Vibrio cholerae O395
MFTGSNTSFQDTTIENDGFWPNINAGDFERLRGTPAAQDDERIAHAVVNAIASVNLQLSDLKAKYIAAGHASAADVPAFPKVNDKNLIVIQYQSAVFARAKADLLPDFATVSQKKEGDHLAERSQETKNELLAESERIIRNMLGKNRASVELI

SEQ ID NO: 8836 - protein, 153 aa, Pseudomonas aeruginosa PA7
MSFSGKPTHVIQQAIPNDGFWPDLDVAEFQRLYRMPAEYLLDLLVDGVTTARAEVNQDLAKRKRAWQTAGVTRLETADPQVLPDRAEYVAHYKRAVYCRAKAQLLGQFATVNRRPEAENLAKEAEQTRELFLSYSQQAVRLIQGRSRITAELI

SEQ ID NO: 8837 - protein, 153 aa, Pseudomonas aeruginosa PA7
MSFSGKPTNVIQQAIPNDGFWPDLDVAEFQRLYRMPAEYLLDLLVDGVTTARAEVNQDLAKRKRAWQTAGVTRLETADPQVLPDRAEYVAHYKRAVYCRAKAQLLGQFATVNRRPEAENLAKEAEQTRELFLSYSQQAVRLIQGRSRITAELI

SEQ ID NO: 8838 - protein, 161 aa, Marinomonas MWYL1
MSLTGKPSLTTAAPVANDGFWPDLSLSDLMNRYRIPSEYADDTISWGLSLALVRVNEQLERAKKAVLVIPFETFDGYLESSSAAALKVHYEHAVYSYAKAFLLQQFSTMNRRKEAENMAKESAETEQYWLDESKKSVAAILRHFVPGEEHSTKANFFVGLI

SEQ ID NO: 8839 - protein, 140 aa, Vibrio harveyi ATCC BAA-1116
MMGFGGKVDKASNQVISGEGWPDLTNDEFRQLRRIPHTFDNDSIAVAITIAANNIQEKLVSLLVEGMPPSLSVAKTALYKRAVYGRAHSELLPEFATQDRRKEGDNAALDEPQQAARFLAQSNKDVSQLLGRSANGIGVI

SEQ ID NO: 8840 - protein, 150 aa, Yersinia pseudotuberculosis YPIII
MFNGKEIDYQDVELTNDGFWPDLNLSEFQRNRSIPADIDADTQADALLASVAEVNLDLRPLAAGYVAKGYQQAAAVPGVAMNGQTALISQYKKAVFARAKADLLGEYSTQFSRVPNAGQENPETRSRLLAEASTVLRNMKGVGRCTVRQI

SEQ ID NO: 8841 - protein, 167 aa, Salmonella enterica serovar Newport SL254
MCHCAVETGQSAFFGGFMFSGKPLDYQDEPLANNGFWPDLNLKDFQVQRSLPPDIDADTISQALLAAVAEVNAELENVEASWKAKGHTLAADVPGVKMGGLNSLCAQYMKAVFARAKADLLGEFATIGRRDTHPGQESQETRAGLLAEASVVIRRMKGLKRATVKKV

SEQ ID NO: 8842 - protein, 167 aa, Salmonella enterica serovar Heidelberg SL476
MCHCAVETGQSAFFGGFMFSGTPLDYQDEPLANNGFWPDLNLKDFQVQRSLPPDIDADTISQALLAAVAEVNAELENVEASWKAKGHTLAADVPGVKMGGLNSLCAQYMKAVFARAKADLLGEFATIGRRDSHPGQESQETRAGLLAEASVVIRRMKGLKRATVKKV

SEQ ID NO: 8843 - protein, 150 aa, Salmonella enterica serovar Agona SL483
MFSGTAIDFDDAILTNDGFWPDLSVKDFQSQRAIPADIDAATIRQALLTAAGEINDDLVRVVADCRLSGHASAADVPGVEIDGENLLCARYRKAVFARAKADLMGEFASVGRRESHPGQESDETRSSLIAESTLAVRRIKGLKRITVAMI

SEQ ID NO: 8844 - protein, 154 aa, Aliivibrio salmonicida LFI1238
MFSGSSGADYQDTVIENDGFWPNLNAGDFEKRRSIPTDMDSETVAYALAAAIAQINIALINKKTAYEAEGITSASDVPGQPMIDNKNLLVILYEKSVFARAKADLIPEFAMVQTKDAGDRVAENETLITERLLAESQQHIRAIFGKSRVGVELL

SEQ ID NO: 8845 - protein, 155 aa, Desulfovibrio desulfuricans ATCC 27774
MSSLKGFGITTGKTATTVLDGDGFYPDLAVAEFMELYRLPAEYAEALIADHLDLARLWAAGELAAWREKQQASGHTALDQISVHGISGGALRLYKRAVFCRAKALLLPQFATIERREPARNDAKEAPESAQAFFAQAANALAAITGRTFISVEAI

SEQ ID NO: 8846 - protein, 205 aa, Ralstonia solanacearum
MRSLAGVAVIAIAALSYWIGVQRLHASRAEAAVPHSGQQAVAQSGLPDGKGAADARAGHRSDRTAAKPATADAQAQPATGTDGPTPRARLAALRPPLSPESENDPFTVLSWLPPAPPPPAAAAPAPEPAPPPSAPALPFVYLGTLNPEAAKPQVFISSGDRLLIVSPGDVIDGVYRFESIAATEARFTYLPLNQRQVMSVQGEGN

SEQ ID NO: 8847 - protein, 170 aa, Ralstonia solanacearum
MKPVNRRLAFLLLALAGSAGLVLFGSPATQTEVVQPSRSAAPSQPPAMSTGPASASAEDMTVLALRPREASPDIAQAFPSRDWAPPPPPPPPPAPPPKPTAPPLPFVVIGKKWEDGQWQVFLGRNEETFVVKAGDTFDGRYRVDSIVPPSMTLIYLPLKARQTLTIGNME

SEQ ID NO: 8848 - protein, 176 aa, Thiobacillus denitrificans ATCC 25259
MSLSPAKRKIALGVALAATLGATVWVGEQEDAAPELVAQAVPRPAAESAGRPAPPASGPAITRGGLKREISREPVPDVFAAKSWYVPPPAPKYVPPPPPPPPPAPVPPPLPFVYLGKLVDNGEITVFVVFKGRNLAVKANEVIDSTYRIDSVDARSMALTYLPLDMKQTLSLGERN

SEQ ID NO: 8849 - protein, 174 aa, Thiobacillus denitrificans ATCC 25259
MNDKRRRLLLFVALAAVVGWSSRLALDEAAVDAEDAAIELAEPARVRADAPRAAAPAAAASAKAEPVTKARLELARADLFPQQTWYVPPPPPPPPPAPPPPPPPQAPALPFAYMGRWDEAGTVTYYLARGGAKPVSVRPGEVLDGVWRLEPTTGRTLSFTYLPLNQTRSLQTGE

SEQ ID NO: 8850 - protein, 174 aa, Nitrosospira multiformis ATCC 25196
MKPTEKARRLWLAGALLATLLVAQWVSGEEGEAGPETLPDSAEAPHFQKEAPAGRNAPENEAAELDLGRLERRKFSAQAGDIFGQRSWVPPPRPEPPRRPSPPPMQFRYLGKVVEGNETRVFLALGERNYIVRPGESINNQYRLDEVSDRGITFTYLPLNARQMLATAGTANIP

SEQ ID NO: 8851 - protein, 177 aa, Methylobacillus flagellatus KT
MKQTPGQRLVWVALTMTLAATAWTALNGEQADEVHVAASRPQGVSTEVKNQPKSRTSGEARPAGADSLDVAQLQRAPWQDSEHNLFGGGQLVAQAETAQQPIVQQAMEIPPVPFTYAGKLEDHGQFTVFLSLGEKNVSVKTGDIVGDWKIKEITPSRMILSYQPLRADVPLMIGESN

SEQ ID NO: 8852 - protein, 202 aa, Cupriavidus metallidurans CH34 uid250
MTHDLARKILIGTTGFVLAAVVSWSVMPDPRTNPALAAINTGPSWGTMTRHGASSDAAAASHAHHSAAKHPPASAAVAQTQTHAAPREQLEKLRKPMSAEPGHDPFTASSWLPPPPPPPPPEPVVEPPPTPPPLPFSFLGALDGNTPKPQIFLGNGDRLLIVSRGDVIDGQYRIDAIATESITFTYLPLNMKQVLPTQSEGK

SEQ ID NO: 8853 - protein, 168 aa, Pseudomonas putida F1
MNTQRAVIWAGFLGVSAALAWAPDHWFGQDDGVAAFAGKPAPATESAASMVGAGLPAKGPEQASRDLFPTQQWTPPKTLATVTEQPVMTAPVVAAAPTAPELPFQFIGRMGDRDDLQVFLQSGEKLYVVRQGDVIEDTYRLDRVSASELNLVYLPLHQSQTLSVGSAP

SEQ ID NO: 8854 - protein, 169 aa, Pseudomonas putida GB 1
MNTQRAVIWAGFLGVSAALAWAPGHWFGQEDALAPVAGKPAPTETAGSAASAGAALAAKGPDQASRDLFPTQQWTKPKALATVTEQPVVAAPAVVPAPTAPALPFEFIGRMGDRDDLQIFLQSGEKLYVVRQGDVIEDTYRLDRVSASELSLVYLPLHQSQTLSVGSAP

SEQ ID NO: 8855 - protein, 165 aa, Pseudomonas putida W619
MNTQRAVVWVGFLGLAGALAWAPGHWFGEESEEALIAGKPVPTQPVSESAGMPVMKPEQATRDLFPRQQWTKPKALATVTEQPVVATAVVAAAPAAPALPFQFVGRLGDRDDLQVFLRSGEKLYVVRQGDVIDDTYRLDRVSANELGLVYLPLHQSQTLSVGSAP

SEQ ID NO: 8856 - protein, 206 aa, Leptothrix cholodnii SP 6
MKAARHWRPALLLATLAGLLALAVGAPNAPPTSPAPTSTTAMTASATAPRLVPARATAARSAARAGAPTPADPPITGRDAALSALDTGLVARRTAAGGKAPDAFAAHSWHVAPPPAPPAPVVWQPPPQPAPPQAPPLPFKYLGRMEESPERTVWYLLQGERLIVKASGEAIDSSYRIDGAEAGQLRFTYLPLGQQQSLTLPIGAPP

SEQ ID NO: 8857 - protein, 175 aa, Azotobacter vinelandii DJ
MERRRLLGWLAFLGGAGLLALLPEFFPQEEELLALEARPGGAVAKPETRSGEVRPEAHGVRGGPASGTPVPQADLFAARSWRASRPASGSASPSALVARPPAAPVAPPLPFEFVGRLDDSVRLRVFLLQGDRLHTVEAGEVIDGTYRLERIADDELTLVYLPLNQTQSLSVGDNP

SEQ ID NO: 8858 - protein, 70 aa, Bacillus anthracis Ames 0581
MKRGIIDRFEGELAVIEVNNVTIDVPKSKLPSTAKEGDVLIIEDDTYTIDKDETDKRRREIQDLMNKLFE

SEQ ID NO: 8859 - protein, 70 aa, Bacillus anthracis str Sterne; identical to SEQ ID NO: 8858

SEQ ID NO: 8860 - protein, 70 aa, Bacillus cereus ZK
MKRGIIDRFEGKLAVIEVNNVTIDVPKSKLPSTAKEGDVLIIEDDTYTIDKDETDKRRREIQNLMNKLFE

SEQ ID NO: 8861 - protein, 72 aa, Moorella thermoacetica ATCC 39073
MRRHELLVIDRFEDDMAVIEYGQRTFNLPRSLLPRAAKEGDVIKLAVVLDPEATARRKKEVRSLADEVFEKG

SEQ ID NO: 8862 - protein, 70 aa, Clostridium thermocellum ATCC 27405
MRLIVDRFEGDFAVCENENKEMINVCRSELPADVKEGDVLLKMNDKYVIDTAATEERKKKISRMMDELWE

SEQ ID NO: 8863 - protein, 84 aa, Herpetosiphon aurantiacus ATCC 23779
MLVVFDRYEGEHAVLIDQHNHQIYNIVIGCLPASAQVGDYLDLSFDTANQPQLILAPEQRQAAEQRITAKLERLRRGDHLANNS

SEQ ID NO: 8864 - protein, 70 aa, Clostridium phytofermentans ISDg
MKYIIDRFEGTYAVCEDEMKNMVNIPKYKLPMEVKEGDSLIDDDGIIRINDKEADERRKKVNQMMSKLFK

SEQ ID NO: 8865 - protein, 73 aa, Thermoanaerobacter sp. X514
MPKKNEICVIDRFEGDWAVIEWKDKIFNFPRELLPKEVNEGDVLIFNVDVDKSETEKRKKAIEDLAKDLFKDE

SEQ ID NO: 8866 - protein, 70 aa, Bacillus cereus AH187
MKRGIIDRFEGELAVIEVNNITMDVPKSKLPSTAKEGDVLIIEGDTYTIDKDETDKRRREIQDLMNKLFE

SEQ ID NO: 8867 - protein, 70 aa, Bacillus cereus AH820; identical to SEQ ID NO: 8858

SEQ ID NO: 8868 - protein, 70 aa, Desulfitobacterium hafniense DCB 2
MKGIIDRFEGEFAVIEQEDRVIINVPRHALPREAKEGDSLVLSNGEYLIDPSETAKRKKRIEELSRELWE

SEQ ID NO: 8869 - protein, 70 aa, Halothermothrix orenii H 168
MIIIDRFEGEKVILEYSNNQGKIITFAVPANVLPRKAKEGDILNIIIDNELTKQRKKRLEKIKDNLFENN

SEQ ID NO: 8870 - protein, 91 aa, Atopobium parvulum DSM 20469
MKAIIDRFEDNNLAVLELNDQSGNMLTISRHKLPSNACQGDILYYQDGVWTIAEEETTQRQNDIDELFNSLLVRDDNEDDSYQDDAYSKDE

SEQ ID NO: 8871 - protein, 66 aa, Desulfotomaculum acetoxidans DSM 771
MLIIDRFEEDQAVIEFGDRLFVIPKLFFPLDAKEGDVIKLKITVDREATSSRAKIIKGLSEELFDS

SEQ ID NO: 8872 - protein, 230 aa, Shewanella oneidensis
MIKHHPHAELLQAHAQGELPLSMSMAVAAHCALCQECQNQIAKLTEQAAKLAFVSSSDDPVQHNASNEIDVVDNDPWQQMLSNIMALPESTMSEPYIESSVTVSHRNIRYQIPRVFRQHIALPWQQIGKVSRMRFDIDEKNTRASLLYIEALGEIPQHTHKGFELTLLLSGEFSDSTGNYVVGDFIILDGNTQHSPTTQTGCLCYTVLDAPLYFTKGISKLLNPIGELIY

SEQ ID NO: 8873 - protein, 220 aa, Pseudomonas syringae tomato DC3000
MGPLHHPDDATLISYAAGALSQVIAVVTAAHLERCAECRARLRQAEQIGGVLMQQSISRVVPLKSRMAMLARLDEQETSVDSVMHAMPAANHDPDLLPHCMHAHFGRHLSTLKWKTLIPGVQRVSAQGIEQGNLMLLKIAPGVSMPVHSHESGEMTMVLKGAYHDVQGEFGLNDVADLDSHIQHQPIAYPDRECICVLAAESKLRFHGWMARMMQPFFGI

SEQ ID NO: 8874 - protein, 220 aa, Pseudomonas syringae pv B728a
MGPQHHPDDATLVSYAAGALSQVISLVTAAHLERCAECRARLRQAEAIGGVLMQQHTSSVVPLKGRSAMLARLDEQQAGLVPAMHSMPAANQDPDLMPVCMQAHFGRHLSTLKWKTLIPGVKRVRAEGIEQGNLMLLKIAPGVSMPVHSHESGEMTMVLKGAYYDVQGEFGLNDVADLDSHIHHQPIAYPDRECICVLATESKLRFQGLLARMMQPFFGI

SEQ ID NO: 8875 - protein, 228 aa, Colwellia psychrerythraea 34H
MINHHPKFELIQAFVNGDLPASLSAGIAIHADMCPVCQQTIAQFTEQVAENSFEEEYLDRFIIDDNEALEAIATIDFDHMIDNIVESSDIAVVVPKVEKTVSFNDTTYTLPAALNSMEMGKHAQIGKLTRARIQLNENEIHSSLLHIQPGGGVPEHTHKGFELTVLLAGSFHDESGEYVKGDFIMLDSSHQHHPISSNGCLCYTVANDALHFTHGINKLLNPIGSFIY

SEQ ID NO: 8876 - protein, 219 aa, Rhodopseudomonas palustris HaA2
MTVRHHIGDDLLLSYAAGTLDEASSLLVATHLALCPACRARAAAADDLGGALLDALPAAELSPGLHDAVLARLRAEPLAAPAPATPLRPRSEIVIPEPLRSYLGGDFETLRWTKLAPRVHQIAIDLPNCRPRARLLRFQAGTRVPAHSHAGRELTLVLSGSLCDRDAVLARGDVAETDEHTEHQPHAGPGDDCICLAVTDAPLRFKGVLARLLQPWFGI

SEQ ID NO: 8877 - protein, 213 aa, Jannaschia CCS1
MTEMNHSVPDDMLMGYASGSLAKAFDLVLATHVSLNDDARARLETFEALGGAILCGMDTVDVDDDSLEQTMAKIRGNAPIERPAPSEGLFPTPLQSMVGGDVDAVRWRSVGGGVKQCVLHSDDGGTVRLLSIAAGRAMPAHSHHGTEMTLVLQGAYRDDDGIFARGDLELADTDTNHQPVAEPGQDCICLVATNAKLKFQGLLPRIAQPFLGI

SEQ ID NO: 8878 - protein, 223 aa, Saccharophagus degradans 2-40
MANFHPSDNTLIEYSAGNLPAALAICVAAHLEYCPQCSHRASQLNSLGGTLLETSAKAQVASTSFTQLMARIQAAPTMGDIKAPVATATKTSAKPNLPKVINKLIHPARPLKWKRVSPALKEAIVTVGQDQYEVCFHRIKRGGKVAEHDHGGTEITVVLEGSFSDELGTYTVGDYIEKQPGDIHRPMATQNEDCLCLSVSEAPVKITGLLGKLINPFISFAPR

SEQ ID NO: 8879 - protein, 224 aa, Shewanella denitrificans OS217
MNIMINYHPHKPVLTSFVDGDLPASISIMIASHVELCAQCKTQVQLLTDQAAMVQFESNAEDFDTSDMDLDALAMIDTITQITADNHDSLPQTVTEIAIAGQRIPLPRALKSVALKPWQGLGNLSRARLDLQDDERRMSLLYIAPGGSVPRHTHQGFEITLLLQGSFEDEMGQYHTGDFIWLDGNHTHQPATADGCVCLTVSSDAIRFTQGMSQLLNPIGKFIY

SEQ ID NO: 8880 - protein, 218 aa, Rhodopseudomonas palustris BisB5
MTVRHHIGDDLLLSYAAGTLDEASSLLVATHLALCPHCRARAAAADDLGGALFEDLPVAELSPGLRDAVLARLRSESVAAPATRPHRPRSDIVIPEPLRSYLGGDLDTLRWTSVAPRVQQIAIDIANCGPRARMLRFQPGTHVPAHGHAGRELTLVLSGSLCDRDAVLARGDVAETDEHTEHQPYAGPDKDCICLAVTDAPLRFKGMFARMLQPWFGI

SEQ ID NO: 8881 - protein, 211 aa, Ruegeria sp. TM1040
MTGITHHIPDELLIAYAAGSLTKAFSLVVAAHVSMCDECRARLGAHEALGGALLDDMPVAEVSADMKGRLFDALDDPVAREKRYDRAGIFPAPVMEALGGLPPKWKPLGLGVRQMILDHDRSGSVRLLYIPAGQGVPDHGHNGLELTLVLQGAFYDETGHFGVGDLEVADGDLEHEPVAADGPACICLAATDASLRFRSFVPRLLQPIFRI

SEQ ID NO: 8882 - protein, 223 aa, Pseudoalteromonas atlantica T6c
MINFHPDLAHLRAFAEGTCPTNLALMISAHVDMCPRCQAITMQAQEEVGLEVFPTNLEAVEPQPDFNDMMLQIMQTPNVEAPVLQPVNNMLELDGKHFALPRALARYTHKTGNWSRLVGKLWQAPVDLGQVGQANFIYMEKGGKVPEHTHKGTEFTLVIDGQFSDGLADYDCGDFTIMDSTKKHMPFSEADEGCLVFTMVDKPLHFTSGLARLLNPFSQLFFK

SEQ ID NO: 8883 - protein, 224 aa, Rhodospirillum rubrum ATCC 11170
MTLSHHPSESLLAAYAAGVLGEGASLIVAAHLTLCPHCRGAVDHLEALGGALLEEMAPLALAEGALDAVLARLDTPAAPSPTRATASRLPPPMGEAALLPAPLRRHLADPSAATLPWRAIAPGIRQIALLPRTAGGGNAHLLKIAPKTALPRHGHHGQEYTLVLAGAFQDRSERFARGDVAEVEADRVHQPITDGQDCLCLVVTEGPLRYMGMIPRLMQPFTGF

SEQ ID NO: 8884 - protein, 231 aa, Shewanella sp. MR-7
MIKHHPHTDLLLAHAQGELPLSMSIAIAAHCALCHECQSQVSRFTEQAAELAFLAPSNITEQALISETDSAQDDAWQQMLSHIMDLPEATPVESDYPAKATVSLNHKHVRYEIPTVFRQHIAHPWQQIGKVSRMRFDVDESHTRASLLHIDALGEIPQHTHKGYELTLLLAGEFSDLNGQYVPGDFIILDGNTHHSPKTQSGCLCYTVLDAPLYFTKGLSKLLNPIGELIY

SEQ ID NO: 8885 - protein, 213 aa, Rhodobacter sphaeroides 2 4 1
MTIRHHVSDALLTAYAAGTLSEAFSLVVATHLSLCDECRARAGALDAVGGSLMEETAPVALSEGSLASVMAQLDRQIQRPAPARRADPRAPAPLADYVGRRLEDVRWRTLGGGVRQAILPTGGEAIARLLWIPGGQAVPDHGHRGLELTLVLQGAFRDETDRFGAGDIEIADQELEHTPVAERGLDCICLAATDAPLRFNSFLPKLVQPFFRI

SEQ ID NO: 8886 - protein, 231 aa, Shewanella sp. MR-4
MIKHHPHTDLLLAHAQGELPLSMSIAISAHCALCHECQSQVSRFTEQAAELAFLAPSKITEQALISETDSAQDDAWQQMMSQIMALPESTPTESDYPAKTTVSLNHKHVRYEIPRVFRQHIAHPWQQIGKVSRMRFDVDENNTRASLLHIDALGEIPQHTHKGYELTLLLAGEFSDLHGQYVPGDFIILDGKTHHSPKTQTGCLCYTVLDAPLYFTKGLSKLLNPIGELIY

SEQ ID NO: 8887 - protein, 227 aa, Maricaulis maris MCS10
MTQRGHTLDDAWYLGYAAGSLASEAETVLVQSHVELNSDAQDRVEQLDRIGGVLLDRMPVGEALPFSADELLEMADRSDPLQAGESVSDEAANVPDALDGVNLPPALAQYLARSPARLKWEFLGPGLRKSILWRGKDGERLWLLKAQPGVAIPHHGHAGSELTLVLKGSFWDGDQEYRRGDVEEAHEDVEHDIRIGTGGECVCLALTQGKLRFESPLLTAFQVFTGL

SEQ ID NO: 8888 - protein, 228 aa, Shewanella frigidimarina NCIMB 400
MINYHPDQHLLSLHAKGELPLSMSIAISAHAELCPHCQQQLDQMTIALSEQQFESAVKTQSVDTNDNHQLDALLEQLLNSTLDTLEIEQASTIDTIEDNSVSIKGQHYPLPKVFRKQINASWQGIGKVSRLRLDTGEPQARASLLHIAANGEIPEHTHKGAELTLLLAGEFSDCYNTYKPGDFMLLDKEHQHSPKTLEGCLCYTIVDAPLYFTKGFSKLLNPIGDLLY

SEQ ID NO: 8889 - protein, 231 aa, Shewanella sp. ANA-3
MIKHHPHTDLLLAHAQGELPLSMSIAIAAHCALCHECQSQVSRFTEQAAELAFLAPSQTTEPAFISETDTAQDDAWQQMLSHIMDLPEATPTENDYLAKATVYLNHKHVRYEIPTVFRQHIAHPWQQIGKVSRMRFDVNESHTRASLLHIDALGEIPQHTHKGYELTLLLAGEFSDLNGQYVPGDFIILDGNTHHSPKTQSGCLCYTVLDAPLYFTKGLSKLLNPIGELIY

SEQ ID NO: 8890 - protein, 262 aa, Shewanella amazonensis SB2B
MIKHHPSDEMLLTHAAGETVLGLAIALSAHCELCPTCAAKVEHFQHKLAMHHLPLPDQTSEAAPSGVISKSASEGHIDQSGVSALDSAWDISWESQDNSLDSLFDAITATPAANAAQISATAGNAVLLATEVKGVSYSLPKAFRPFIANPALASSWSGIGQVSRMRLDTRDGKARSSLLHIAAGGEIPEHTHKGQEITLLLHGHFSDEMGDYAPGDFMVTDTRHQHTPKTLDGCLCYTVVDAPLHFTKGLSKLLNPIGELIY

SEQ ID NO: 8891 - protein, 216 aa, Psychromonas ingrahamii 37
MIKHHPTSALLASHSAAQLPLSLSIAVSAHLEMCPKCVTVTRQITEQQSDLFEAQDVTKNINFSNILDKIFEHQPERQVEPKKVVMNSISVAGTEYQLPRAFTHFTDLKWSSFGAISRARVVKDTDNIRASLLHIDKNSIIPSHTHKGYELTLLLEGAFSDESGVYNKGDFIWLNNDLEHTPFTKEGCLCYAVQDAPLRFVSGISQALNPLGQLIY

SEQ ID NO: 8892 - protein, 223 aa, Acidovorax avenae citrulli AAC00-1
MTIHHHPGDDLLLDLAAGRLPPGPALLASVHAEMCPQCGQRLRALEAAGGVLLESLPPETLRPDALSRVLGAIDALPGDDARRPGAAAEPVAGGPDWPAGTPWPQALRGVAFSPWKWIAPGMRWSRPLSPPAGDVNVFLLRIGPGRSLPAHTHGGLEWTQVLHGAFHDGHALFGAGDFDAADGNVHHQPVVQGPGDCICLAAVDGRLRFDGMLARLAGSLVGM

SEQ ID NO: 8893 - protein, 212 aa, Marinobacter aquaeolei VT8
MTRHHPDSLSLMEYSAGNLSEPHALCIRLHLEQCPHCRSRVDTLNSLGAVMMDHQPKVTVADSSFEQLMARIDSSPQASSPVVPQPKVSPLQKLLGDDINALPWKRQLADVSVLDITDKFPGQNERVVLQKLVAGGKAPAHTHRGDETTIVLQGAFADQKGVFNQWDFVVLNEQDEHRPVAVGCEDCITLSVLSAPLKLTGTFTRLLNPFLR

SEQ ID NO: 8894 - protein, 243 aa, Shewanella baltica OS155
MIKHHPQQELLVSHANGVLPLSMAIAVSAHCALCETCREQLALLTEQAANSALNPDGAHAHAAKQHIGQELIHTAHIDAGNTQATNVPVMDIDDMLAQIMAQPAATDVPNNAPLDVQVKQQHYTVPSVFRQHLARPWQILGKVSRMRFDVDEMNTRASLLHIDAQGEIPQHTHKGYELTLLLAGAFSDLNGDYVPGDFIVLDSQHHHSPKTVDGCLCYTVLDAPLHFTKGLSKLLNPIGELIY

SEQ ID NO: 8895 - protein, 213 aa, Rhodobacter sphaeroides ATCC 17029
MTIRHHVSDALLTAYAAGTLSEAFSLVVATHLSLCDKCRARAGALDAVGGSLMEETAPVALSEGSLASVMARLDRQIQRPAPVRRADPRAPAPLADYVGRRLEDVRWRTLGGGVRQAILPTGGEAIARLLWIPGGQAVPDHGHRGLELTLVLQGAFRDETDRFGAGDIEIADQELEHTPVAERGLDCICLAATDAPLRFNSFLPKLVQPFFRI

SEQ ID NO: 8896 - protein, 249 aa, Shewanella loihica PV-4
MINHHPNSDVLAQFVAGTLPASVSVLVASHVELCSECTRAVQALTEQAAIDAFGESSQEALRDASQPAGLADVSGLDDFDGLDDFDTSDQFGDSDEFADCINAITALERDDTQQLPQTVTEIAVGGERIPLPTALRSIPLKEWQGMGKLSRSRLALDDGDLRMSLLHIDKGGSVPCHTHKGFEITLLLQGSFTDEMGEYRKGDFIWLDGQHTHQPVTEKGCVCLTVSSDAIRFTQGVSQLLNPIGRFIY

SEQ ID NO: 8897 - protein, 235 aa, Shewanella putrefaciens CN-32
MIKHHPNQQLLLAHVKGELSLSMAIAVSAHCALCDTCKTAVAQYTKEAASLAFNQEEIADTTADKADISAHSIAFMEYDVPEELQTMLAQILCQPESTTTPSYEPLFVSVKNQQYSVPSVFRQHLDYPWQQLGKVSRMRFDLDEMNTRASLLHIDALGEIPQHTHKGYELTLLLAGEFSDINGHYVPGDFIMLDQHTKHAPKTLEGCLCYTVLDAPLHFTKGLSKLLNPIGELIY

SEQ ID NO: 8898 - protein, 214 aa, Rhodobacter sphaeroides ATCC 17025
MTIRHHISDALLTAYAAGSLPEAFSLVVATHLSLCDDCRARAAALDAVGGRLMEEAAPVALSEGSLAAVMSRLDRRIEVPARPARRADPRAPAPLADYVGGRLEDVRWRALGGGVRQAILPTGGEAIARLLWIPGGQAVPDHGHRGMELTLVLQGAFRDETDRFGPGDLEIADQELEHTPAAEAGIDCICLAATDAPLRFNSFLPKLVQPFFRI

SEQ ID NO: 8899 - protein, 226 aa, Vibrio cholerae O395
MSYHPNYALLAAYAEGGLDSAHGLAISAHLEICPHCRDLVHEIEAELGELLNQQAASSVALSDDANWQAMFDSIVALPQQAASNTPVKTTPVMVTVNGKQIAIPKVLARLVKPEQQWRSYGGKVFSLPLQSEDNVRMNLMYISQGVSIPQHTHKGFESTLVLHGGFSDENGHYDVGDFMQHDGQICHSPSTPQDQDCLCLTVLTEPMVFTQGVARIFNLFGKGLYP

SEQ ID NO: 8900 - protein, 216 aa, Bradyrhizobium BTAi1
MTISHHPPEDLLADYATGALDEAEQLVVGVHVADCPRCRRFVRAIERLAGASIEAAEPVAVAADAFDAVMARIDRRPQAAPRVSEAAEHDPELADLPEMVKRCKIGKRRRVAPGISMRPIMLSGTGKSRAFLLRSEPGARMLEHTHSGSELTCVLKGSFSHLGGYYGPGDFDYGDDEVDHRPVVGDEGPCLCLVAMTGDLRMHGLLGRLISPFVRL

SEQ ID NO: 8901 - protein, 231 aa, Marinomonas MWYL1
MINYHPSIEILTDYAAGSLPLAHSLCVSTHLERCHECQQQIRKLEMLGSHLFDQTKADSRQLSNLKDSFFEKINAQAEQKSDLLKTEEEPTAIDWGNYTVPKSLRQFIKKSYDDLNWMRLSPSFKIATLYNEEGGAQIALTRVKAGAHMPTHTHTGDEITLVLEGAFSDESGVYRQGDFINRDASHKHKPIVTKDAECICLTVLDAPIEFTGWLTRLLNPIIRRYHPHSSR

SEQ ID NO: 8902 - protein, 240 aa, Shewanella baltica OS185
MIKHHPQHELLVSHANGVLPLSMAIAVSAHCALCETCREQLALITEQAANSALNPDGAHAAKHIDQESIHTAHINAEHTQATNVPVMDIDAMLAQIMAQPAATDVPNNAPLDVQVKQQHYTVPSVFRQHLARPWQILGKVSRMRFDVDEMNTRASLLHIDAQGEIPQHTHKGYELTLLLAGAFSDLNGDYVPGDFIVLDSQHHHSPKTVDGCLCYTVLDAPLHFTKGLSKLLNPIGELIY

SEQ ID NO: 8903 - protein, 226 aa, Parvibaculum lavamentivorans DS-1
MSAHFLHHPVRHPLGEEWLMAYAAGALSEGQSLLVASHLSYLDDTASRLAVAEAAGGALLEAVDPARMAPEALANTLARLDETRQETKAAPRAKDQTNDVLPPPLRAWLGRGVDELNWSLLGPGMKKVKLWRGGPNDQRLWMLRARPGIEIPMHGHSGTELVLVLKGSLEDEHGIFRAGDVEESNDDRIHSLRTGPEEECICLAVTEGPTRFQGWLARALQPLIGL

SEQ ID NO: 8904 - protein, 235 aa, Xanthobacter autotrophicus Py2
MSVHSHPGDATLLRYAAGTLPAGPALLVEIHLQGCPHCRAAVRRFEAVGGALLDAAEPAALAADAFARTLARLGPAPVSGGLTGGGARRDHLEAAFSGPAAAPRLPEGLVLPEGVRLPRPLTSRRIGAMMPVAPGVRVGRVHVPEDGQSNVFLFQIGPGRAIPRHTHDGTEYTHVICGGFSDPSGHYGAGDLVEADGDVEHSPRVDDDGTCICLAAFEGRLRFRGLLGVVLRPFL

SEQ ID NO: 8905 - protein, 219 aa, Vibrio harveyi ATCC BAA-1116
MNKHPDKTLLEAYASGSIDAVSGLVVATHLETCPKCRAYVNQLEAAQASLVNDIPSIYDAEFDSMLNDIITSELTSDSIIVRDVAKVMVAGKDFKLPKTLSRFSDLVGEWKSYGGKVYSAQIDLGEEARVNLMYISEDVRIPQHTHKGQESTLVLQGGFSDEDGHYEVGDVLVRDASAKHSPFTKPGEDCLCLTVLTEPMIFTQGVARIFNMFGKGMYP

SEQ ID NO: 8906 - protein, 223 aa, Dinoroseobacter shibae DFL 12
MTGIKHHLNDALLMAYSAGTLPEAFSLVVATHISMCDDCRAALAAHDAVGGALLEDTAEVELAPEALDKCLAAIQALPPKGPIKLPKSMTNGSAPRSSVFPSPLAEYVKGDVEDVNWRSVGLGVRQAILPTSKEASVRLLYIPAGAEVPDHGHHGTELTLVLQGAFRDEFDRFGPGDIEVADPNVEHTPVAEAGEACICLAATDAPLKFRSILPKIAQPFLRI

SEQ ID NO: 8907 - protein, 243 aa, Shewanella baltica OS195
MIKHHPQQDLLVSHANGVLPLSMAIAVSAHCALCETCREQLALLTEQAANSALNPDGAHAHAAKHHIDQESIHTAHIDTGNTQATNVPVMDIDAMLAQIMAQPAATDVPNNAPLDVQVKQQHYTVPSVFRQHLARPWQILGKVSRMRFDVDEMNTRASLLHIDAQGEIPQHTHKGYELTLLLAGAFSDINGDYVPGDFIVLDSQHHHSPKTVDGCLCYTVLDAPLHFTKGLSKLLNPIGELIY

SEQ ID NO: 8908 - protein, 212 aa, Caulobacter K31
MSSHRGPSEELLLAYAAGVLSSPEAVVVATHLALRPAADAWVRRLQTVGGEFLETTAPVALSTEALTRTLARIETDAGEVERPRPANDMAELPEPLRRYALGPWRWIGPGMRVRDVHAPRDGKCRVILLRIDPGRETPRHTHGGVELTCVLTGAYATETDRFDVGDLEEADSEVLHRPRVVSDKPCLCAVALDGEIQLDGWLGRLMQPFVRL

SEQ ID NO: 8909 - protein, 246 aa, Shewanella woodyi ATCC 51908
MIKLHPKGPLLSSFVEGSLPASLSVVIASHIEMCPECQKQVELLTEQAANACFGESSTSATQSGLGPQVERLCEELMDSDIEASLSGSELSMLDAITSITEVEHSAETVDLAAIIDKEIEVSGAKFKVPRALRNIEIKPFQGLGKLSRSRLNIEDGDLRTSLLHIDKGGSVPTHTHKGFEVTLLLQGSFEDEMGVYQAGDFIWLDAEHTHQPVTKTGCVCLTVSNDAIHFTKGVSQLLNPIGQFIY

SEQ ID NO: 8910 - protein, 220 aa, Rhodopseudomonas palustris TIE 1
MTVRHHIGDDLLLSYAAGTLDEASSLLVATHLALCPHCRARAAAADALGGEMLDALPAAAVTPQLWQNVLARTQDQPETPPAIPATALRPRSDIVIPEPLRSYLGTDLAGLRWTRLAPRVQQITIDIPGCRPRARMLRFEAGTRVLEHGHSGRELTLVLHGSLCDGAAVMRRGDVAETDEGTEHQPQAGPDGDCICLAVTDAPLRFKSRFARLLQPWFGI

SEQ ID NO: 8911 - protein, 214 aa, Stenotrophomonas maltophilia R551 3
MSYAAGALPAPLSIVAGTHLEQCPQCRQRLRDAEVIGSVLLEQTQPPQSGGDAHRTALRDAMLRRLTTESPVSVAAPVRPVPPERPEADPDHLPASLHPYFGTSLSGLRWRWMAPGVHCIRAEQMPSLIMLKIAPGKCLPMHSHGRSELTQILRGSYNDALGLFAPGDMADLDGDVEHQPVTAPGVPCICVSALDAPLVFSGWLARKIQRFVKL

SEQ ID NO: 8912 - protein, 246 aa, Alteromonas macleodii  Deep ecotype
MIRFHPSARQLSDFVEGTLSPAISLMVSAHCDMCEKCQRFVEVETERLAKDLVSGAGVGDKLEVSFQLDEMLSQITQLPTAPQIESKAIKANNAVASPRNQEANISQRKATNAIELDGRVFTLPRTLHRYIDKTGNWSSLVGKLWQAPVDLGNQGVANFIFMGRGGSVPEHTHRGTEYTLVIDGEFSDGLNRYDTGDFIFMDGEKTHTPKSEDKDGCLVFSIVDQPLHFTSGLARLLNPFSHLFFR

SEQ ID NO: 8913 - protein, 243 aa, Shewanella baltica OS223
MIKHHPQQDLLVSHANGVLPLSMAIAVSAHCALCETCREQLALLTEQAANSALNPDGAHAHAAKHHIDQESIHTAHIDTGNTQATNVPVMDIDAMLAQIMAQPAATDVPNNAHLDVQVKQQHYTVPSVFRQHLARPWQILGKVSRMRFDVDEMNTRASLLHIDAQGEIPQHTHKGYELTLLLAGAFSDINGDYVPGDFIVLDSQHHHSPKTVDGCLCYTVLDAPLHFTKGLSKLLNPIGELIY

SEQ ID NO: 8914 - protein, 230 aa, Agrobacterium vitis S4
MTVHHHVSDELLLDYANGSLAEGWGIAIATHLALCPDCRRRLATMEVTAGALLEAEKPVDADLSVDRSWQDMRARLTASGERSRESTVSRVEASPDATRRQRDAILPEPLRSYLGQDLDGLKWKSLGRGAYHIPIKTRDGETSVRLLRIPAGKPVPEHSHGGRELTLVLKGSFHDGQGRFARGDLEEADEQLEHQPIAEDGEDCICLAVTDAPLRFKSRLVRLFQPILGI

SEQ ID NO: 8915 - protein, 413 aa, Clostridium perfringens SM101 uid12521
MENRVVITGLGAITPIGNNVNEFWTNAKKGVCGIDEITLFDTSDYKVKIAAEVKNFKAEEFIDKKEAKRLDRFTHFALVATEEAMKDAKLDLKDENVDPNRVGVIVGSGIGGYGTLESQFDVLLTKGPNRVSPFAIPSGIINLVAGNIAIKYGAKGVCESLVTACATGVSSIGAAYRSIKHGYSDIVISGGSEASITRAAIAGFTNLKALNINNDPKRASIPFDKERSGFVMGEGAGILILESLESAKKRGARIYGEIIGYGATCDAYHITSPDPEGDGAKRAIEAAIEEGKINKDEISYINAHGTSTPLNDKFETLAIKGCFGEKAYDIPVSSTKSMTGHLLGAAGAIESVICVKALEEGFIPPTIGYKVPDEDCDLDYVVNEGREAELNYVINNALGFGGHNASLLFKKWD

SEQ ID NO: 8916 - protein, 410 aa, Streptococcus agalactiae 2603
MTLQRVVVTGYGVTSPIGNTPEEFWNSLKEGNVGIGPITKFDSSDFMVKNAAEIHDFPFDKYFVKKDLNRFDMYSLYALYASSEAIQHANLNLDEIDADRFGVIVASGIGGIQEIEEQVIRLHEKGPKRVKPMTLPKALPNMAAGNVAMRLGAHGVCKSINTACASSNDAIGDAFRNIKFGIQDIMVVGGAEAAITKFAIAGFQSLTALSTTEDPSRASIPFDKDRNGFIMGEGSGMLVLESLEHAEKRGATILAEVVGYGNTCDAYHMTSPHPEGLGATKAIQLALVEANIKPEEVNYVNAHGTSTPANEKGESQAIVAALGTDVPVSSTKSFTGHLLGAAGAVEAIATIEAIRHSYVPMTAGTTELSEDITANVIFGQGQDADIRYAISNTFGFGGHNAVLAFKRWED

SEQ ID NO: 8917 - protein, 413 aa, Clostridium perfringens ATCC 13124
MENRVVITGLGAITPIGNNVKEFWTNAKKGVCGIDEITLFDASDYKVKIAGEVKNFKAEDFIDKKEAKRLDRFTHFALAATEEAMKDAKLDLKDENVDPNRVGVIVGSGIGGYGTLEAQFDVLLTKGPNRVSPFAIPSGIINLVAGNIAIKYGAKGVCESLVTACATGVSSIGAAYRSIKHGYSDIVISGGSEASITRAAIAGFTNLKALNTNNDPKRSSIPFDKERSGFVMGEGAGILILESLESAQKRGARIYGEIIGYGATCDAYHITSPDPEGDGAKRAIEAAIEEGKINKDEISYINAHGTSTPLNDKFETLAIKGCFGEKAYDIPVSSTKSMTGHLLGAAGAIESVICVKALEEGFIPPTIGYKVPDEDCDLDYVVNEGREVELNYVINNALGFGGHNASLLFKKWD

SEQ ID NO: 8918 - protein, 410 aa, Oenococcus oeni PSU-1
MTRVVITGMGAVTPLGSSVNEFVSGLRKQQVGFRPISTFDSSATGVTLAGEAADFDPLVRLSKKDLRRMDRFSQFAVYSALEAYQQAGLEDQTPDPERFGVIYGSGIGGLTTIQEQVIRMHDLGADRVSPMFVPTAIANMAAGNLAIRFHAQNICMTIVTACSSGANAIGEAFRAIESGRADIMLTGGSEASINEIGIGGFAALSTLSKATDPTKASLPFDKNRNGFVMGEGGGTLILESLEHAQKRGAEILGELVGYGASEDAYHITSPDPAGTQAARAMRLAIEEAGLKAEQIGYINAHGTATHGNDFAEAAAINQVFSKDQQVLVSSSKSMTGHLLGAAGAIEAVATVSALRDGQLPVNVGITEQDPECQVNLVTEENAQTKVDYALSNSFGFGGHNAVLAFKKWSD

SEQ ID NO: 8919 - protein, 420 aa, Leuconostoc mesenteroides ATCC 8293
MTRVVITGLGAVTPLGNDTQSFLDGIFNEKIGIKPITKFDASETGITVAGQVDGFDPAARVGKRDARKMDLFSQYAVDAADQALTNAGLKAEEGAEAPTTVADPTRFGVILGNGIGGLTTIQDQVIKMHDKGPQRVSPLFVPESIPNMVSGNVSLRFGAKGINSTIVTACASATNAIGEAFWRIQSGKADVMLTGGSEATVNEIGIAGFAALTALSKEEDPTQASKPFDKNRHGFVLGEGSGILVIESLEHAQARGAHILAELVGYGASSDAYHMTSPSPDGEGAARAIRDALNDANLEANQISYINAHGTATGANDSGEAHAIATVFGENTVPVSSTKGMTGHLLGAAGAIEALISVGSLTRGELPVNVGLDEQDEDTKVVNLVDQENKHQAPEYVMSANYGFGGHNAVIVFKKWHEGV

SEQ ID NO: 8920 - protein, 411 aa, Lactococcus lactis cremoris SK11
MTNRVVITGYGVVSAIGNSPEEFWNNLKAGKTGIGPITHFDAEATGISVAAEVKEFPFDKYFQKKDARRMDTFSLYAVYAALDAMEMSGITEENTNFDRLGCIMASGIGGLEQSQKNSQAIVAKGPRKGVAPLYVPLAIANMATGNVALRTGARGVSRAEVTACAAGANAIGSAFREIKHGYADAMIAGGAEAAICELGIAGFANLTALTKETDPEKACIPFDKNRSGFVMGEGSGVLILESLEHAQARGANILAEIVGYGNTNDAFHMTTPSGVGAENAIKLALEEAGASPADVDYVNAHGTSTHANEETESKAIHNVIGDKAYVSSTKALHGHALGATGAIEAVATVQALLNQYAPVNAGTTELDEGMTINVVLGEGKPAEINLALSQDFGFGGHNAVLAFKKWENAAE

SEQ ID NO: 8921 - protein, 410 aa, Streptococcus thermophilus LMD-9
MSTNRVVVTGYGVTSPIGNTPEDFWNSLHDGKIGIKPITKFDASEIPVFNAGEIQDFPFDKYFVKKDTNRMDTYSLYAIYAAMEALENSGLNMEEVNRDRVGVIVSSGIGGLQELEDQIIRMYERGMKRIKPMFIPKALSNMGAGNIALKIGAQGVCKSVTTACASANDAIGEAFREIKFGFHDVVLAGGAEASITKIGIGGFNALTALSTTEDPERSSIPFDKDRNGFVMGEGAGVLVIESLEHAQKRGANILAEIVGYGSNCDAYHMTTPTPDGSGAAKAIKLAINEAGIKPEDVDYVNAHGTSTPANEKGESGAIVSVLGKDVPVSSTKSFTGHLLGAAGAVEAIATIEAIRHSFVPKTAGTKELSDYIEANVVYGEGKEADIEYAISNTFGFGGHNAVLAFKRWEG

SEQ ID NO: 8922 - protein, 410 aa, Lactobacillus reuteri DSM 20016
MTRVVITGMGAVAPNGNGIQEFISNSFAGKVGIKAIKKFDAKPTGITVAGEIDDFDPNDVIGRKAARRMDLYSQYALQSAIEAMEMAEINETNTKPVDMGVIYGSGIGGLTTIQEQIIKMHDKGPRRVSPMFVPMSIANMAAGNISIHFNAQNICTSIVTACATGANAIGEAFRQVKEGRAKVMIAGGSEASVNEIGIAGFAALTALSQATDPLKASLPFDKARQGFVLGEGGATLVLEDLEHAQKRGANILGEIVGYGATSDAYHITSPDPTGAGAARAMELAIKEAVINPSEISYINAHGTATHANDEGESKAINQVFGSDSNVRVSSTKGMTGHLLGAAGAIEAVLTVAALQKGQLPLNIGCFNQDPKCSVNLVTAENSDASNARYAISNSFGFGGHNAVLAFKKWE

SEQ ID NO: 8923 - protein, 411 aa, Clostridium phytofermentans ISDg
MKRVVVTGMGVITPIGKNVEDFWSNIKSGTTGFGPITYFDTTDYRAKLAAEVKDFNAADYMDGKSARRMEKFCQYAVAATKEAIESSGLDLTKEDRTRIGVSVGSGIGDLVIIEKEYEKVLNNGPKRTNPLFVPLMISNMAAGNVSINFGLKGKCINVVTACATGTHSIGEAYRAIQCGDADVMVCGGTEAAISKLGIAGFGALTALSSSEDPKRASIPFDKERNGFIMGEGAGVVVIESLEHAKARGANILAEVAGYGATADAFHITSPAEDGEGAMRAMLLAVKEAGLKPEDVDYINAHGTSTHHNDLFETKSIKAAFGEHAYHLNVNSTKSMTGHLLGAAGAVEFIVCVKSVQEDFIHATVGYSVPDEELDLDYTKEARTDKKVNVAISNSLGFGGHNGTLLVKKYVE

SEQ ID NO: 8924 - protein, 405 aa, Slackia heliotrinireducens DSM 20476
MVTGLGVVSPLGSDMDTFWKNVTDGVCGIGPITRFDTSQYKAKVAAEVKDFDPAQYLSTNELLRTDLYAQYAIGAAEQAVSESGIVGTLPPDRLGVYFGSGIGGLETVCSGVAKLNEQGPRRVSSLIIPMMIANMAAGLIAIRYDCQNGAMPAVTACATGSNAIGEAVRTIRHGYADAVIAGGSEASIVPLGVAGFVNMRALSTADDPMAASLPFDARRAGFVMGEGAGALVLEELEHARARGAHIYGEISGYGSTCDAYHMTASHPEGDGGRRAIAQALEESGYTGDERLYINAHGTGTPINDACETLAIKGALGQEKGREALVSSTKSMTGHMLGAAGAVEAIVCLKVLQTGIVPPTINLLEPDPECDLNHVAQTAVQAEIDLCLSNSLGFGGHNATLAFRKV

SEQ ID NO: 8925 - protein, 117 aa, Jannaschia CCS1
MARVTVEDCVDKVPNRFELVMLASHRAREIAAGDPLTIDRDNDKNPVVSLREIADETQSADDLRERLIESHQTQIEVDEPEEDAMALLQGVEQDRPAQDDMSEEQMLRALMEAQGQK

SEQ ID NO: 8926 - protein, 117 aa, Ruegeria sp. TM1040
MARVTVEDCVDKVPNRFELVMLAAHRAREISAGAELTVDRDNDKNPVVSLREIAEETQSADALRERLIESNQSQIEVDEPEEDSMALLMGGEADKPQEDDMSEEKLLRALMEAQGQG

SEQ ID NO: 8927 - protein, 138 aa, Rhodospirillum rubrum ATCC 11170
MARVTVEDCVLKIPNRFELVLVAGQRARDISAGSALTVDRDNDKNPVVSLREIADGTVDIPNLKEAVIQGLQKHVEIDEPEEDDFDAMGLDRDLMPGVALAEDDDTLEADGLTIHDGADSDLDLSDDAGQDTDEADED

SEQ ID NO: 8928 - protein, 117 aa, Rhodobacter sphaeroides 2 4 1
MARVTVEDCVDKVPNRFELVMLAAHRAREIASGSSLTIDRDNDKNPVVALREIAEETQSAESLRERMIESHQTQIEVDEPEEDQMALLMGSEVDRPVQDDMSEEKLLRALMEAQGQN

SEQ ID NO: 8929 - protein, 123 aa, Maricaulis maris MCS10
MARVTVEDCIEKIPNRFRLVLMAAHRARNISAGSELTIDRDNDKNPVVALREIADETLDMDSLKDSLVNGLQRVLPSEDEEDAAREERGQQMEALPAPPVELDEAEMLKALQNDRDGAPDGRL

SEQ ID NO: 8930 - protein, 118 aa, Paracoccus denitrificans PD1222
MARVTVEDCVDKVPNRFDLVMLAAHRAREIAAGSPLTVDRDNDKNPVVSLREIADETQPVDDLRERMIEAQQTQIEVDEPEEDAMALLLGAEMDRPKPADEESEERMLRMMLEAQGRN

SEQ ID NO: 8931 - protein, 117 aa, Rhodobacter sphaeroides ATCC 17029; identical to SEQ ID NO: 8928

SEQ ID NO: 8932 - protein, 117 aa, Rhodobacter sphaeroides ATCC 17025
MARVTVEDCVDKVPNRFELVMLAAHRAREIASGSALTIDRDNDKNPVVALREIAEETQSAESLRERMIESHQTQIEVDEPEEDQMALLMGSEVDRPVQDDMSEEKLLRALMEAQGQN

SEQ ID NO: 8933 - protein, 136 aa, Acidiphilium cryptum JF-5
MARVTVEDCIEQIPNRFELVLLAAQRARNLSRGASITIDRDNDKNPVVALREIADSTVDFGGLEQDLVKSLSRVPDPEPADEEVQDLIPTDQNIFGLQDVSAEEEAAAMAAESEEMTSEDIAAAIEAELGGGRPRR

SEQ ID NO: 8934 - protein, 141 aa, Parvibaculum lavamentivorans DS-1
MARVTVEDCVDKVPNRFELVLLAGHRARAMSAGAELTVDRDNDKNPVVALREIADRTIMPEDLREELIGSMQSRVETEEPEVEQMQLLMSGEAAGEVKDTFGAAEGGGERMSEEDLLRAIQSQIDSPQQKSADADDMDGED

SEQ ID NO: 8935 - protein, 118 aa, Dinoroseobacter shibae DFL 12
MARVTVEDCVDKVPNRFELVMLAAHRAREISAGSELTIDRDNDKNPVVSLREIAEETQSADALRERLIESNQTQIEVDEPEEDSMAMLMGGGQPDKPAEDDMSEEKLLRALMEAQGQP

SEQ ID NO: 8936 - protein, 132 aa, Gluconacetobacter diazotrophicus PAl 5 JGI
MARVTVEDCVERVPNRFELVLLAAQRARGLSRGEELTVDRDNDKNPVVALREIADQTIVLEQIRSDLVRSLARAPEPEPADEEVMDLIPTEQNIFGLQDVSAEEEASHGTAGMSAEELEAAIEAELGGRARR

SEQ ID NO: 8937 - protein, 212 aa, Escherichia coli BL21 (DE3)
MAVAANKRSVMTLFSGPTDIYSHQVRIVLAEKGVSFEIEHVEKDNPPQDLIDLNPNQSVPTLVDRELTLWESRIIMEYLDERFPHPPLMPVYPVARGESRLYMHRIEKDWYTLMNTIINGSASEADAARKQLREELLAIAPVFGQKPYFLSDEFSLVDCYLAPLLWRLPQLGIEFSGPGAKELKGYMTRVFERDSFLASLTEAEREMRLGRS

SEQ ID NO: 8938 - protein, 205 aa, Pseudomonas syringae tomato DC3000
MGVTNRLACYSDPADHYSHRVRIVLAEKGVSAEIIEVVAGRHPPQLIEVNPYGSVPTLVDRDLALYESTVVMEYLDERYPHPPLLPVYPVTRANSRLLIHRIQRDWCGLVDLILDTRSKEPARVQARKELRESLTGVSPLFAEKAFFMSDELSLVDCCLLPILWRLPILGIELPRPAKPLLDYMERQFAREAFQASLSAAEREMR

SEQ ID NO: 8939 - protein, 205 aa, Pseudomonas syringae pv B728a
MGVTNRLACYSDPADHYSHRVRIVLAEKGVSAEIIEVVAGRHPPQLIEVNPYGSVPTLVDRDLALYESTVVMEYLDERYPHPPLLPVYPVARANSRLLIHRIQRDWCGLVDLILDTRSKEPARVQARKELRESLAGVSPLFAEKAFFMSDELSLVDCCLLPILWRLPILGIELPRPAKPLLDYMERQFAREAFQTSLSAAEREMR

SEQ ID NO: 8940 - protein, 208 aa, Chromohalobacter salexigens DSM 3043
MGVVAKRSSMTFYSGSDDHYSHRVRIVLAEKGVAVDVIEINDDNHPDELADLNPYNSTPTLLDRDLVLYESKVMMEYLDERFPHPPLLPVYPVARAQSRLWMHRIEREWCPLVETIQQGSKKDAEKARKELRESIAGISPIFEDMPFFMSEEFSLVDCCIAPILWRLPALGVELPEKQVKPLMNYMERLFSRDAFKASLLEAEKEMRT

SEQ ID NO: 8941 - protein, 212 aa, Haemophilus somnus 129PT
MTSAANKRSIMTLFLDKVDIYCHQVRIVLAEKGVAYATEIVDSESISEDLMELNPYGTIPTLVDRDLVLFNSRIIMEYLDERFPHPPLMPVYPVSRGKSRLLMLRIEQDWYPVLEKAEKGSESERAIALKQLKEEILAIAPVFSQSLYFMSEEFSLVDCYIAPLLWRMQQLGVVFTGTGSKAIKSYMERVFQRDSFLQSVGEMTPKNLMEDK

SEQ ID NO: 8942 - protein, 212 aa, Enterobacter sp. 638
MAVAANKRSVMTLFSGPTDIYSHQVRIVLAEKGVSFEIEHVEKDNPPQDLIDLNPNQSVPTLVDRELTLWESRIIMEYLDERFPHPPLMPVYPVARGESRLYMQRIEKDWYTLMNVIVNGSSSEADAARKQLREELLAIAPVFGQKPFFLSDEFSLVDCYLAPLLWRLQSLGVEFSGPGAKELKGYMTRVFERDSFLASLTEPEREMRLGRG

SEQ ID NO: 8943 - protein, 210 aa, Marinomonas MWYL1
MGVIAKRSSMTFFSDGEDHYSHRVRIVLAEKAVTVDIIDVDPFNKPDELADVNPYNELPALVDRDLVLYEPNVMMEYLDERFPHPPLLPVYPVARAESRLFMYRIQRDWAKLVDLILTSKDKEAVAKAQKELREGLLNVTPIFEEKPYFMSDEFTIVDCCLAPILWRLPVLGVEIPKDQARALYKYMDLVFSRESFQESLSEAEQEMRLD

SEQ ID NO: 8944 - protein, 212 aa, Escherichia coli HS; identical to SEQ ID NO: 8937

SEQ ID NO: 8945 - protein, 212 aa, Escherichia coli E24377A; identical to SEQ ID NO: 8937

SEQ ID NO: 8946 - protein, 213 aa, Serratia proteamaculans 568
MAVAANKRSVMTLFSGPTDIFSHQVRIVLAEKGVSVEIEQVELDNLPQDLIDLNPYQTVPTLVDRELTLYESRIIMEYLDERFPHPPLMPVYPVARGESRLMMLRIEKNWYSLMYKIEQSNGQEAESARRQLREELLAIAPIFGQTPYFMSEEFSLVDCYLAPLLWRLPQLGIELSGAGSKELKGYMTRVFERDAFLASLTEAEREMRLQTRG

SEQ ID NO: 8947 - protein, 209 aa, Coxiella burnetii RSA 331
MLKRSIMTLYSGPLDIYSHQVRIVLAEKGVTVDIHNVDANHPSEDLIELNPYATLPTLVDRDLVLFESRVIMEYLDERFPHPPLLPVYPVARSRCRLLMYRIERNFYHSMKIIEEGTPKQAETEREFLTKELIELDPVFGEKTYFMNDDFTLVDCVMAPLLWRLPHLGVHVPPRAAKSMYKYKKLIFERESFKASLSESESELREVDGI

SEQ ID NO: 8948 - protein, 213 aa, Yersinia pestis Angola
MAVAANKRSVMTLFSGPTDIFSHQVRIVLAEKGVSVEIEQVEADNLPQDLIDLNPYRTVPTLVDRELTLYESRIIMEYLDERFPHPPLMPVYPFARGSSRLMMHRIEHDWYSLLYKIEQGNAQEAEAARKQLREELLSIAPVFNETPFFMSEEFSLVDCYLAPLLWRLPVLGIEFTGAGSKELKGYMTRVFERDAFLASLTEAEREMHLKTRS

SEQ ID NO: 8949 - protein, 212 aa, Escherichia coli C ATCC 8739; identical to SEQ ID NO: 8937

SEQ ID NO: 8950 - protein, 213 aa, Yersinia pseudotuberculosis YPIII
MAVAANKRSVMTLFSGPTDIFSHQVRIVLAEKGVSVEIEQVEADNLPQDLIDLNPYRTVPTLVDRELTLYESRIIMEYLDERFPHPPLMPVYPVARGSSRLMMHRIEHDWYSLLYKIEQGNAQEAEAARKQLREELLSIAPVFNETPFFMSEEFSLVDCYLAPLLWRLPVLGIEFTGAGSKELKGYMTRVFERDAFLASLTEAEREMHLKTRS

SEQ ID NO: 8951 - protein, 212 aa, Shigella boydii CDC 3083 94; identical to SEQ ID NO: 8937

SEQ ID NO: 8952 - protein, 212 aa, Salmonella enterica serovar Newport SL254
MAVAANKRSVMTLFSGPTDIYSHQVRIVLAEKGVSFEIEHVEKDNPPQDLIDLNPNQSVPTLVDRELTLWESRIIMEYLDERFPHPPLMPVYPVARGESRLYMHRIEKDWYTLMNVIVNGSASEADSARKQLREELLAIAPVFGQKPYFLSDEFSLVDCYLAPLLWRLPQLGIEFSGAGAKELKGYMTRVFERDSFLASLTEAEREMRLGRG

SEQ ID NO: 8953 - protein, 212 aa, Salmonella enterica serovar Schwarzengrund CVM19633; identical to SEQ ID NO: 8952

SEQ ID NO: 8954 - protein, 212 aa, Salmonella enterica serovar Dublin CT 02021853; identical to SEQ ID NO: 8952

SEQ ID NO: 8955 - protein, 212 aa, Escherichia coli O157 H7 EC4115; identical to SEQ ID NO: 8937

SEQ ID NO: 8956 - protein, 213 aa, Dickeya dadantii Ech703
MAVAANKRSVMTLFSGPSDIFSHQVRIVLAEKGVSVEIEQVDMDNLPQDLIDLNPYGSVPTLVDRELTLYESRIIMEYLDERFPHPPLMPVYPVARGNSRLMMHRIEQDWYSLLKTILNGNAQDVEAARKQLREELLAIAPVFNEAPYFMSEEFSLVDCYLAPLLWRLPLLGIELSGSGAKELKAYMTRVFERDAFLASLTEAEREIRLQTRG

SEQ ID NO: 8957 - protein, 213 aa, Dickeya zeae Ech1591
MAVAANKRSVMTLFSGPSDIFSHQVRIVLAEKGVSVEIEQVDMDNLPQDLIDLNPYGSVPTLVDRELTLYESRIIMEYLDERFPHPPLMPVYPVARGNSRLMMHRIEQDWYSLMKTIVNGNAQDAEAARKQLREELLAIAPVFNEAPYFMSEEFSLVDCYLAPLLWRLPLLGIELSGSGAKELKGYMTRVFEREAFLASLTEAEREIRLQSRG

SEQ ID NO: 8958 - protein, 213 aa, Pectobacterium carotovorum PC1
MAVAANKRSVMTLFSGPSDIFSHQVRIVLAEKGVSVEIEQVDMDNLPQDLIDLNPYGSVPTLVDRELTLYESRIIMEYLDERFPHPPLMPVYPVARGNSRLMMHRIESDWYSLLKKITHGSAQEADAARKQLREELLAIAPVFNEAPYFMSEEFSLVDCYLAPLLWRLPQLGIELSGSGAKELKGYMTRVFERDAFLASLTEVEREMRLQTRG

SEQ ID NO: 8959 - protein, 162 aa, Escherichia coli BL21 (DE3) [sequence omitted]

SEQ ID NO: 8960 - protein, 162 aa, Shewanella oneidensis
MSLQAANGRIVVWLTLFVGLLSQIMPLPTIVEAWRPDWLLMILIYWSIALPHRYNILTAWVMGLALDILLGATLGVRSLAMSLVIYIAILHCQRLRNFPKWQQSLVVMLLIAIYHLIVYWVEFVMDGATFHAELFLPALSGLVFWPWIFWILRRIRRHYKVR

SEQ ID NO: 8961 - protein, 163 aa, Pseudomonas putida KT2440
MMAASRRNNGWVIWLTFAIGLLLSVSPMPQFMEVFRPMWLALLVSFWTLAVPNKVGMTTAFVLGLAEDVLYGTLLGQNALVLTLITFLVLSLQQRLRMFPMWQQSLVILVIFGIAQLIQLWLSALTGNRLPTLALVWSAVISALLWPWISFALRDLRRRLHIN

SEQ ID NO: 8962 - protein, 163 aa, Pseudomonas syringae tomato DC3000
MVSHVSGRNGWVVWLTFAIGLLLSVSPLPQFMEIFRPLWLALLLTFWVLALPHKYGMTTAWILGLMEDVLYGTLLGQNALILSLITFLVMSLQQRLRMFPMWQQCLVLLVVFGLAQLAQLWLSALTGNRQPTLALVLPALVSALLWPWVSYGLRGLRKRLKIN

SEQ ID NO: 8963 - protein, 163 aa, Methylococcus capsulatus Bath
MWRTRRTPSRILIFASLAAAMAMRIVPLPQDWALWNPDWILLVLIYWAVMAPDRVGVGTAWLTGLLADALTGRLLGQDALAYSVVIYVGVRFHRRFRVYSMVQQVLAVVLLLGLGLLLTLWTRHIRGLASAPEGYWFAALSGGLVWPWVRVALDGLRRRYGAA

SEQ ID NO: 8964 - protein, 163 aa, Pseudomonas syringae pv B728a
MVSHVSGRNGWVVWLTFAIGLLLSVSPLPQFMEIFRPLWLALLLTFWVLALPHKYGMTTAWILGLMEDVLYGTLLGQNALILSLITFLVMSLQQRLRMFPMWQQCLVLLVVFGLAQLAQLWLSALTGNRQPTLALVLPALVSALLWPWISYGLRGLRKRLKIN

SEQ ID NO: 8965 - protein, 161 aa, Psychrobacter arcticum 273-4
MAYPDSDHANGLLHAVIVLSFIIASSLSVYPLSPSMATLRPMIMIMILIYWLLFQPRYVGIFSAFTIGLIADLLMDTHLGQQAFSAVVVALMIKVTSIYIRQLNTVSAWIIASLGLFVFQASLWMLQMFVQNVFVAQSTFSLLMSIISWPLVLLTLRKFVR

SEQ ID NO: 8966 - protein, 159 aa, Colwellia psychrerythraea 34H
MFSNNGFIIFLTLLIALMASITPMPLSVDAFRPDWVLIVLVYWCLALPNKINIFTAWVMGFILDVLLGSVLGVHACAMALSVYIVVVNFQKIRNFSVWQQALIIGVLSAQYHLVVFWLQRFLSDVVFLPNYLYPVITTIVLWPWVFLLLRRVRRHFRIE

SEQ ID NO: 8967 - protein, 173 aa, Dechloromonas aromatica RCB
MQPTFSSSRILLPVRPWFIFFSLIAAALLNFLPTAHWPGMPDWIALVLCFWSVREFRKVGMGWGFALGLLMDVADGAVLGQHCFAYVILAYTAASLSRRILWFPLVQQALQIMPLLLAAQVLQALMRLAVGADFPGWGYFVGPLIATLLWIPATFILLLPQYRPVEQDPNRPI

SEQ ID NO: 8968 - protein, 166 aa, Thiobacillus denitrificans ATCC 25259
MNVAAETSGRWRRILGSLTLAVLVEQLPWSGLAMVLRPDFVLVALLFWVLHQPQRVGFGIAFFLGLIADFQDGAALGQHGIAYVVGVYLVLYLRLRLLQFDPFRQAAQLFPVLLAVQLVVLLGGWLAVNPPAGLAILMPVFGSTFLWYLSALVLRLWHGKGAQDSH

SEQ ID NO: 8969 - protein, 167 aa, Thiomicrospira crunogena XCL-2
MSDKVFSLRFSDIKWLLIFSYFISVVIDSMMILSFNINFVPYFTLLILLFWSTQILNQTHLFSAFALGLLFDASMNTPLGSHSLIFVTITFLMLRSRLRFKGYPLWQQSMIVGSYFIIFQAMSWFIFHPVLVGNALLYYWIEPLLAILIWPVLTQVMHRLTHRSVFS

SEQ ID NO: 8970 - protein, 173 aa, Nitrosospira multiformis ATCC 25196
MTLANSSRHEILMPAKSWFIMLSLIVALLLNLIPVTGTARTLQPDFVALVMLYWYLNEPQRVGIGMAFWMGLLMDLSNASTFGQHALGYSVMAFMALVFNRRMGIFEGYKQAPQIGLVLLSGQIVTLLAGLFAGSPFPGWNFFLGSIVGMLLWPLLSAILRVPQKPWSASDAR

SEQ ID NO: 8971 - protein, 162 aa, Saccharophagus degradans 2-40
MPNLGLSFYIFFCVSAFFALVLSIYPIPHAYAALRPELFCLLVVYWVINYPQYFGVTTAWLMGLFLDVVHSTVWGAHALGLAAVAYICLSSYQRIRSYSLWQQTLWVFVFVGIHQVIVNWMLGLSGYHKPTHIILVTTAVSALSWPVMVLLFRRLRRRYRLL

SEQ ID NO: 8972 - protein, 159 aa, Methylobacillus flagellatus KT
MSATSLKPVYLSLLVALLMQILPWSGSLLTIRPEFLLLTVLYWTLRAPHLCNIGTAWFAGLMMDLASGGLFGQFALAYSAASFFAVSYQRRLALFNIWQQAGYVFLLLLLSQVITLVLKLFSGGELPGWQYFLPSVSGILLWQFVTFSRLRIDSRSDQA

SEQ ID NO: 8973 - protein, 163 aa, Shewanella denitrificans OS217
MSNHIANGRLIVWVTLFFGVMFQIMPLPSLVELWRPDWLLMVIMYWAMALPHRYSILTAWFLGVVLDILLGAHLGIRAMAFSLVTYIVVLHFQRLRHFPRWQQSIVIAAFICLYHLVVFWLEFIVVGGVQFKTEYLQPVVSSIFIWWWVFWVLRNIRRSYKVR

SEQ ID NO: 8974 - protein, 159 aa, Chromohalobacter salexigens DSM 3043
MRLPGLIAIWLTLVISLCLQVMPLPDAWLMWRPNWLGLALAYWCVTAPQRVGVFHGFVCGLLLDLIEGTPLGQNALTLSLLTYLCLLLYQRLRAYSIWQQAVMLFVLLGLIQLVEQWLRTIFGPVSIHLAFLLPALIGGALWPWLFTMMQVLRRRLGIT

SEQ ID NO: 8975 - protein, 161 aa, Psychrobacter cryohalolentis K5
MAYPDSDHANGLLHAVIVLSFIIASSLSVYPLSPSMATLRPMIMIMVLIFWLLFQPRYVGIFSAFAIGLIADLLMDTHLGQQAFSAVAVALMIKVTSIYIRQLNTISAWIIASLGLFIFQASLWMLQMFVQDVFVAQSTFSLLMSIISWPLVLLTLRKFVR

SEQ ID NO: 8976 - protein, 170 aa, Cupriavidus metallidurans CH34 uid250
MTTSQYLLRPVNPAFIALTFVLAFLINLMPWGETLWIPDVVALVLVFWNIHQPRKVGMGVAFLLGLLMDVHDARLLGEHALAYTLLAYFAITIHRRVLWFSVYAQALHVLPLLFIAHAVPVVIRLAMGAPLPGWQLLLAPVIEAVLWPMATSLLLAPQRRSNEVDETRPI

SEQ ID NO: 8977 - protein, 158 aa, Baumannia cicadellinicola Homalodisca coagulata
MTRFYRQYNWVIWLFFFFIIIILPIIPCNKPINLFWPSWLNLLLIYWVMVRQNRIHVGIVFLISIIVDLIRGSKLGIHPLLISIIIYIVFIKIKFFRNKNIYQQVIIIILASAIAKFIVNITNYLLLSNSWQTGILSSSIVDGIAWPLVLCIMRKITS

SEQ ID NO: 8978 - protein, 158 aa, Pseudoalteromonas atlantica T6c
MKLRNNTIGLSIIVALVLQIMPMPAIVEQYRPDWVFLVLGYWALALPERVNVGVAFIVGLVLDILLGTSIGVHSFAMSLSVFVLAANYQRLRNYSVWQQAVVIGILCALYNLVVFWLMHLLTDIYFMLTYMWPVITSMVIWPWIFWLLRRVRRQFRLS

SEQ ID NO: 8979 - protein, 184 aa, Rhodospirillum rubrum ATCC 11170
MARRGGLKSTYDPTQPTLWQRLDWLARRLVPVGLTLLLLLMSVAPSRLPGFVHIAPMIALISIYYWAVCRPEVMGYGSAFVLGLVEDSLTGAPLGVGALVLLLTQAVVATQYKFFLNKPFLVTWWAFALVAGVAAVVKWLAVSAIYGTFVDGTALVFSTLFTVAVYPPFAWLFGRVHHMLFREA

SEQ ID NO: 8980 - protein, 162 aa, Haemophilus somnus 129PT
MKVKFLLQILVISGLFIFTFALELMPWPVTFQSFKPSWLVLVLLYWILAIPNKISIGTAFILGIIWDLILGSILGVHALVLSVFAYLIAINHLVLRNLSLWFQGILTILFVIAIRFSIFLIEFFLNGVHFNWQAIFGAITSGILWPWLFLLLRIIRRKLDLR

SEQ ID NO: 8981 - protein, 162 aa, Shewanella sp. MR-7
MSLQAANGRLVVWLTLFVGLLSQIMPLPSIVEAWRPDWLLMILIYWSIALPHRYNILTAWLMGLALDILLGATLGVRSLAMSLVIYIAILHCQRLRNFPKWQQSLVVMVLIVIYHLIIYWVEFVMDGAKFHTDLFLPALSGLAFWPWIFWILRRVRRHYKVR

SEQ ID NO: 8982 - protein, 162 aa, Shewanella sp. MR-4
MSLQAANGRFVVWLTLFVGLLSQIMPLPTIVEAWRPDWLLMILIYWSIALPHRYNILTAWLMGLALDILLGATLGVRSLAMSLVIYIAILHCQRLRNFPKWQQSLVVMVLIVIYHLIIYWVEFVMDGAKFHTDLFLPALSGLAFWPWIFWILRRVRRHYKVR

SEQ ID NO: 8983 - protein, 162 aa, Alkalilimnicola ehrlichei MLHE-1
MNPAIPRGRWVILASLVLAGMLVIVPMPDWAVPARPQWVALVLLYWAMALPSRVGVTVAWLAGLFQDALVGSLLGQHALAFALIAWIILKLHRRMRLMPVWQQALTILLLLYAVQLVLFWVNGFVGRPVPPWQAWLAPVIGAALWPWVFFLLRTARRHFGVQ

SEQ ID NO: 8984 - protein, 163 aa, Shewanella frigidimarina NCIMB 400
MSAHIANGRLVVWLTLFIGMMFQIMPLPKMVEAWRPDWLLMVMMYWAMALPHRYSILTAWLLGVMLDVLLGAHLGIRSLALSLVIYIVVLLCQQLRNYPRWQQSLLVACFICIYHAVIFWVQFVVVGAAPFNVDMFLPAISSLFIWWWVFWVLRNMRRHYKVR

SEQ ID NO: 8985 - protein, 164 aa, Pseudomonas aeruginosa UCBPP-PA14
MARATQGSNNVWVIWLSLLVGLVLAVAPMPTFTEIGRPLWLAMLLTYWVLLLPERVGMVTAWLLGLAQDVLYGNLLGQNALILGLITFLVLSLHQRLRMFPAWQQCLVLVVVYGLAQLLQLWLNALTGNRPPTLTFLLPALVSALLWPWVYALLQFVRLRLNVR

SEQ ID NO: 8986 - protein, 171 aa, Magnetococcus MC-1
MTLAGSLLAPWLPLLSLMLAVAVQEVALPYQAWSVFRPDLLLVALFYWRLYRPDRCGPGSAFGAGVAVDLLSGGPMGINALSKILITLLIRRFGPRLRATDAIFLVPILALLSLLDQMIQLGLATLVQGWGVRWPLLLGRVVSTALVAPLVVGALIHIHRIWLGETPRAGR

SEQ ID NO: 8987 - protein, 162 aa, Shewanella sp. ANA-3
MSLQAANGRLVVWLTLFVGLLSQIMPLPSIVEAWRPDWLLMILIYWSIALPHRYNILTAWLMGLALDILLGATLGVRSLAMSLVIYMAILHCQRLRNFPKWQQALVVMVLIVIYHLIIYWVEFVMDGAKFHTDLFLPALSGLVFWPWIFWILRRIRRHYKVR

SEQ ID NO: 8988 - protein, 162 aa, Shewanella amazonensis SB2B
MSLQAPNRRIVVWLTLFVGLLFQIMPLPDLVAAWRPDWLLLVLIYWTMALPHRYNILTAWILGVVLDVLLGATLGVRALAFSLVIYVVALHFQRMRNFTIWQQSLLVASLVGVFHLVVYWLQYVLTKATYSHAIFWPVLSSLVIWPWVFWFLRRVRRRYKVR

SEQ ID NO: 8989 - protein, 133 aa, Psychromonas ingrahamii 37
MLNAFRPDWMILIIFYWVLALPHRVSIVHAFILGVVFDLLLGSTLGMHALLFSFLAYIVITNYQLFRYFTLVQTTLLVGLYSLLSKLALYLMASSLQDIILHQSYFWSVFTSMLVWPWFFLFLRFIRRRFKVV

SEQ ID NO: 8990 - protein, 172 aa, Acidovorax avenae citrulli AAC00-1
MIMPRGEQLLLPVRPAFIAASLLVALAFNMLPLGRLVWTPDLVMVLLVFWGVHQPQRVGMAVAFAMGLCMDVYQTALLGQHALAYCAMMFGAIYLHRRLLWFSPFSQALQVLPLFLAAHAIELLVRMVSGGILPGLPGLISPVIEALLWPLASWVLLAPQRLPPDRDENRPL

SEQ ID NO: 8991 - protein, 173 aa, Acidovorax sp. JS42
MIMPKGQQLLLPVNPVFIAASLVAALALNMLPLGRVVWTPDWVMVLLVFWGMHQPQRVGLGVAFLMGLCLDVYQSALLGQHALVYCLLMFGAQYTHRRLLWFGPLLQALQLLPLFFAAHALELLLRVAIGGGILPGFEGLVAPLLEAALWPLASWVLLAPQRRPPDRDENRPL

SEQ ID NO: 8992 - protein, 172 aa, Verminephrobacter eiseniae EF01-2
MIMPRGEPLLLPVNPVFIGASLAVGLALNMLPLGRIAWMPDLLMVLLVFWGAHQPLRMGMGTAFVLGLCMDVGQSTLLGQHALSYTVLSFAAVAIHRRLLWFGVPSQALQVLPLFALAHALELLPRLASGGIFPGPGLLAAPLLEALLWPLACGVLLAPQRRPPDSDQNRPL

SEQ ID NO: 8993 - protein, 163 aa, Halorhodospira halophila SL1
MTGHRPRNGGGIILLSFIIALMLTIVPMPGWAQEFRPEWTALILLYWGLALPERVGVGVGWLVGLFQDALLGTLLGQHALAFALIAFLALRLHQHLRLVPVWQQAVVVLGLLVVAQLVVFWINGIIGRPAPEWQAWAAILVGAAIWPLVFHIMRGVRRRFQVQ

SEQ ID NO: 8994 - protein, 158 aa, Marinobacter aquaeolei VT8
MLSVISYPLFAITVVLSLVLSISLFPVDWFQFRPEWLGLIVFYWTFRAPAQFGILMAWCLGLLLDILESTPLGVNAMGMALIAFLVLTIHQRLRMYPLPQQCLMVFLLLGINQMLVHFVKQLLGAESAGFSYLWPALTSALAWPVVSGVLDTINRKLG

SEQ ID NO: 8995 - protein, 162 aa, Shewanella baltica OS155
MSFQAANGRFIVWVTLFIGVISQIMPLPSVVDAWRPDWLLMIVLYWSIALPHRYNILTAWVLGLVLDILLGATLGVRSLAMSLVIYVAILHCQRLRNFPKWQQSLVIMLLICMYHLVIYWVEFVMQEAVFDTDLFLPAISGLVIWPWIFWILRRVRRHYKVR

SEQ ID NO: 8996 - protein, 162 aa, Shewanella loihica PV-4
MSMHIPHGRWVVWLSFLLAMLFQIMPLPGLVEGWRPDWLLLVMIYWAMALPHRYNILSAWVLGVLLDILLGAHLGIRALSMSLVIYVVVLHFQRLRNFPMWQQALMVASLVCLHHLLVFWVQFVVNVASFDVSLFLPALSSLIIWPWVFWMLRRIRRIYKVR

SEQ ID NO: 8997 - protein, 174 aa, Polynucleobacter necessarius asymbioticus QLW P1DMWA 1
MIDFQSGYILRPVNPVFIYFSLFCALLLNLLPIGNYGWVPDWLIICMVFWNIHQHRYVSVITAFILGLMMDVHNSDLLGLHAFSYSLVAYVAISWHRRIVALTVLSQAVHLLPVFLLVALFPVLVHWALSGELYWWALTGAVQAFIEAMLWPLATRILLAPQRRPIDVDHNRPL

SEQ ID NO: 8998 - protein, 162 aa, Enterobacter sp. 638
MASYRSQGRWVIWLSFFIALLLQVMPWPDDLLVFRPNWVLLILLYWSLALPHRVNVGTGFVMGAILDLISGSTLGVRALSMSIIAYLVALKFQLFRNLALWQQALVVMLLSLAADIIVFWAEFLVINVSFRPEVFWSSVVNGVLWPWLFLLMRKIRQQFAVQ

SEQ ID NO: 8999 - protein, 162 aa, Pseudomonas mendocina ymp
MVGVQSRNGWVIWLSLALGLLLSVSPLPEFMQIGRPLWVALILTYWVLALPHRVGMTTAWLLGLAQDVLFGTLLGQNALILTLITFLVLSLHQRLRMFPLWQQSVVLMVVFGLAQLVQLWLNALTGSRPPTLAFVLPALVSALLWPWICGILRGLHLRLNVN

SEQ ID NO: 9000 - protein, 162 aa, Shewanella putrefaciens CN-32
MSLQAANGRLIVWLTLFIGLLSQIMPLPSVVEAWRPDWLLMVVMYWSIALPHRYNILTAWVLGLALDILLGATLGVRSLAMSLVIYIAILHCQRLRNFPKWQQTLVVALLIALYHLVVYWVEFVTDEATFNADLFLPAISGLVIWPWIFWILRRVRRHYKVR

SEQ ID NO: 9001 - protein, 162 aa, Vibrio cholerae O395
MLSSDIKGRMVILASFLLALILQTIPWPGTLDLFRPPWLLLVCCYWVLALPHRVNVGSALVMGLLWDLLLGSTLGIRGMMMSIIIYLVAMNFLVLRNMALWQQAIVIGLLSMGLEVLIFCGEYLIQNVTFNPLSLWSGVIACILWPWMFLLLRRVRRHWHVK

SEQ ID NO: 9002 - protein, 162 aa, Pseudomonas putida F1
MAASRRNNGWVIWLTFAIGLLLSVSPMPQFMEVFRPMWLALLVSFWTLAVPNKVGMTTAFVLGLAEDVLYGTLLGQNALVLTLITFLVLSLQQRLRMFPMWQQSLVILVIFGIAQLIQLWLSALTGNRLPTLALVWSAVISALLWPWISFALRDLRRRLHIN

SEQ ID NO: 9003 - protein, 162 aa, Psychrobacter PRwf-1
MIKSPLSPLQSLLLVIASFVAASVVNIYPLSLDASKLRPMALIMVLIFWLIYKPRYVGVVTAFAIGIISDLLLDTRLGQQGFAAVIMAFSLRFVGQYIKQVNLPVAWTVATGALIVFQLTLWIVQYLTQNIFYASAIFSLLVSVISWPLVFFGLHRFINKYS

SEQ ID NO: 9004 - protein, 164 aa, Pseudomonas aeruginosa PA7
MARATQGSNNVWVIWLSLLVGLLLAVAPMPTFTEIGRPLWLAMLLTYWVLLLPERVGMVTAWLLGLAQDVLYGNLLGQNALILGLITFLVLSLHQRLRMFPAWQQCLVLVVVYGLAQLLQLWLNALTGNRPPTLTFLLPALVSALLWPWVYALLQFVRLRLNVR

SEQ ID NO: 9005 - protein, 157 aa, Marinomonas MWYL1
MKPIFVFCITLLTALMLEAMPFPEELVWFRPEWALLVILYWVIALPFRVGVGLAWFLGLMVDLLQGGIIGQHSLTYVIIAYTCAVFYKRLRMYHRWQQGFFICLLVSINQLLDFWIDHYLGHAEPTLMIFMPAVITGLLWPWSFIILRSVRRIYAIR

SEQ ID NO: 9006 - protein, 162 aa, Shewanella baltica OS185; identical to SEQ ID NO: 8995

SEQ ID NO: 9007 - protein, 162 aa, Yersinia pseudotuberculosis IP 31758
MNRYSSHGRWVIWLSFLIAMVLQIMPWPEQIYMFRPSWLALVLIYWVMALPHRVNVGTGFILGLIMDLILGSTLGVRALAFSIIAYLVAFKFQLFRNMALWQQALIVMLLSLTMDVVVFWSEFLVINVAFRPEVFWSSVVNGILWPWLFLLMRKIRRQFSVQ

SEQ ID NO: 9008 - protein, 162 aa, Vibrio harveyi ATCC BAA-1116
MANSVLRSRMVIGVSFFVALVLQTIPWPGVLDLLRPSWLFLVTCYWVLALPHRVNVGTALILGLLWDILIGSTLGIRGMMMSIIIYLVALNFLVIRNMALWQQSILIAFFTVLLELLIFCGEYLNQDVVFNPLSLWTAAINCILWPWMFLLMRRVRRAWHVR

SEQ ID NO: 9009 - protein, 162 aa, Escherichia coli HS
MASYRSQGRWVIWLSFLIALLLQIMPWPDNLIFFRPNWVLLILLYWILALPHRVNVGTGFVMGAILDLISGSTLGVRVLAMSIIAYLVALKYQLFRNLALWQQALVVMLLSLVVDIIVFWAEFLVINVSFRPEVFWSSVVNGVLWPWIFLLMRKVRQQFAVQ

SEQ ID NO: 9010 - protein, 162 aa, Escherichia coli E24377A [sequence omitted]

SEQ ID NO: 9011 - protein, 162 aa, Shewanella sediminis HAW-EB3
MSMHIANGRWVVWLSFLVAMLFQIMPLPDLVEPWRPDWLLLVIIYWAMALPHRYNILSAWVLGVLLDIMLGAHLGIRALSISLVVYVVVLHFQRLRNFPMWQQALMISSLICLYHLVIFWVQFVVDTATFDVRLFLPAISSLIIWPWVFWILRRVRRLYKVR

SEQ ID NO: 9012 - protein, 162 aa, Serratia proteamaculans 568
MNRYRSNGRWIIWLSFLVALVLQIMPWPEQIYMFRPSWLALILIYWVMALPHRVNVGTGFVLGLIMDLILGSTLGVRALALGIIAYLVAFKFQLFRNMALWQQALIVVLLSLAMDVVVFWAEFLVINVSFRPEVFWSSVVNGILWPWLFLLMRKIRRQFAVQ

SEQ ID NO: 9013 - protein, 162 aa, Shewanella pealeana ATCC 700345
MSLHVANGRWVVWLSLLVAMLFQIMPLPDVVEAWRPDWLLLVITYWAMALPHRYNILTAWVLGVMLDILLGATLGIRAFAMSVVVYVVVLHFQRLRNFPMWQQALLVAMQVAVYNLVVFWVQFVTESAVFDISLFYPAISSLIMWPWIFWVLRRVRRLYKVR

SEQ ID NO: 9014 - protein, 162 aa, Shewanella baltica OS195; identical to SEQ ID NO: 8995

SEQ ID NO: 9015 - protein, 162 aa, Coxiella burnetii RSA 331
MEGNYAKDVLAIGLTLIMAMMLTILPLPAWAVWYQPAWIFMVLLFWMIALPYRVGIGAAFIWGLLFDLLSGTILGQHALIFTIIAYFIIRFQTPLRSLPNWQQMILVFIATAVYLALQYWIMAMADASPETAKYWLPLMSTTLLWPWVRVLLKDYQSRFRLG

SEQ ID NO: 9016 - protein, 162 aa, Yersinia pestis Angola; identical to SEQ ID NO: 9007

SEQ ID NO: 9017 - protein, 162 aa, Pseudomonas putida GB 1
MAASRRNNGWVIWLTFAIGLLLSVSPMPQFMEVFRPMWLALLVSFWTLAVPNKVGMTTAFLLGLAEDVLYGTLLGQNALILTLITFLVLSLQQRLRMFPMWQQSLVILVIFGIAQLIQLWLSALTGNRLPTLALVWSAVISALLWPWISFALRDLRRRLHIN

SEQ ID NO: 9018 - protein, 162 aa, Escherichia coli C ATCC 8739 [sequence omitted]

SEQ ID NO: 9019 - protein, 162 aa, Pseudomonas putida W619
MAKTRRNHGWVIWLTFAIGLLLSVSPMPPFLEVFRPMWLAMLVSFWTLMVPNKVGMTTAFVLGLAEDVLYGTLLGQNALVLTLITFLVLSLQQRLRMFPMWQQSLVILVIFGIAQLIQLWLSALTGNRLPTLALVWSAVISALLWPWISFALRDLRRRLHIN

SEQ ID NO: 9020 - protein, 162 aa, Yersinia pseudotuberculosis YPIII; identical to SEQ ID NO: 9007

SEQ ID NO: 9021 - protein, 162 aa, Shewanella woodyi ATCC 51908
MSMHIANGRWVVWLSFLVAMLFQIMPLPDLVEAWRPDWLLLVMIYWAMALPHRYNILSAWILGVMLDIMLGAHLGIRALSMSLVVYVVVLHFQRLRNFPMWQQALMVASLICLHHLVIFWVQFVVGTVTFDVSLFLPAISSLIIWPWVFWILRRVRRLYKVR

SEQ ID NO: 9022 - protein, 161 aa, Xylella fastidiosa M12
MTRLRNTWLLPVSVILALLLGLLPLPVSVRPIRPYWLALVLMYWVIETPGRVGIGFAFVMGVLADFLYGGLLGEQALRLVVMSFIVQRFRARLRFFPMPQQALVIGGLLFNDCVVATALHLTLGQPLLPWSYWSAPLLGMLLWAPLFVLLDALRLGHGSRK

SEQ ID NO: 9023 - protein, 162 aa, Escherichia coli SMS 3 5 [sequence omitted]

SEQ ID NO: 9024 - protein, 168 aa, Leptothrix cholodnii SP 6
MGDQLLLPVNPWFMWASLLLALGLNMLPLGRLPAMPDLVALALVFWNVHQPRRVGVGAAFCFGLLMDVHEGAVLGQHALAYTLLSYFAITIHRRLLWFSTPAQALHVLPLMAAAHLVTLLLRLATGGHFPGWSLLLSPLFETLLWPLVSLLLLAPQRRAPDPDKHRPL

SEQ ID NO: 9025 - protein, 174 aa, Polynucleobacter necessarius STIR1
MIDFQSGYILRPVNPVFIYFSLFCALLLNLLPIGNYGWVPDWLILCIVFWNIHQHRYVSVITAFILGLMMDVHNSDLLGLHAFSYSLVACVAISWHRRIVALTVLSQALHLLPIFLLVSLFPVLAHWLLSGELYWWALTGAIQTLIEAMLWPIATRILLAPQRRPIDVDHNRPL

SEQ ID NO: 9026 - protein, 161 aa, Xylella fastidiosa M23
MTRLRNTWLLPVSVILALLLGLLPLPVSVRPIRPYWLALVLMYWVIETPGRVGIGFAFVMGVLADFIYGGLLGEQALRLVVMSFIVQRFRARLRFFPMPQQALVIGGLLFNDCVVATALHLTLGQPLLPWSYWSAPLLGMLLWAPLFVLLDALRLGHGSRK

SEQ ID NO: 9027 - protein, 162 aa, Shigella boydii CDC 3083 94 [sequence omitted]

SEQ ID NO: 9028 - protein, 161 aa, Stenotrophomonas maltophilia R551 3
MSRLRDNPWVLPASLVVALLLGLLPLPALLQPLRPYWLALVLAYWVIEAPERVGLGIAFASGVIADLLYGGVLGEQALRLVMLAFILQRFRARIRFFPMSQQMLAIGGLLFNDRIVSALVHIVVDEPTLPWSYWWAPLLGMGLWPLVFVLLDAVRFGKRGR

SEQ ID NO: 9029 - protein, 163 aa, Salmonella enterica serovar Newport SL254
MVASYRSQGRWVIWLSFLIALLLQIMPWPDDIIVFRPNWVLLILLYWILALPHRVNVGTGFVMGAILDLISGSTLGVRALSMSIVAYLVALKFQLFRNLALWQQALVVMLLSLAVDIIVFWAEFLVINVSFRPEVFWSSVVNGVLWPWLFLLMRKVRQQFAVQ

SEQ ID NO: 9030 - protein, 163 aa, Salmonella enterica serovar Heidelberg SL476; identical to SEQ ID NO: 9029

SEQ ID NO: 9031 - protein, 163 aa, Salmonella enterica serovar Schwarzengrund CVM19633; identical to SEQ ID NO: 9029

SEQ ID NO: 9032 - protein, 152 aa, Alteromonas macleodii  Deep ecotype
MIWISLLVALVLQIVPLPTQVDLYRPDWVLVVLAYWSMALPHRVNVGIAFLTGVAMDVLVGTTLGIHSFALSICVYILAANYQRLRNYSVWQQAIIIGLLSSLYHLMTFWVQHLLTDIYFQVDYLWPVLTSMVLWPWVFWLLRRTRRQFSIS

SEQ ID NO: 9033 - protein, 163 aa, Salmonella enterica serovar Agona SL483
MVASYRSQGRWVIWLSFLIALLLQIMPWPDDIIVFRPNWVLLILLYWILALPHRVNVGTGFVMGAILDLISGSTLGVRALSMSIVAYLVDLKFQLFRNLALWQQALVVMLLSLAVDIIVFWAEFLVINVSFRPEVFWSSVVNGVLWPWLFLLMRKVRQQFAVQ

SEQ ID NO: 9034 - protein, 158 aa, Acidithiobacillus ferrooxidans ATCC 53993
MIAVVVVLGFFFALVAEAIPCGPFYASLHPDFVALLLLYWAISSASELSFTVVWLIGLLQDMVLGDVLGAQAIAGVVMIYLLYTGIARVRSLASWEQLFFIFMLLLAHRLLVWSWQAWAGTITWHFSLLLGPLIGALLWPLFTLTLDYLRHALRLNHT

SEQ ID NO: 9035 - protein, 163 aa, Salmonella enterica serovar Dublin CT 02021853; identical to SEQ ID NO: 9029

SEQ ID NO: 9036 - protein, 163 aa, Aliivibrio salmonicida LFI1238
MTSSHLMRGRVIIWLSFLIALILQAAPWPGTLEVLRPSWIILVTFYWVLALPHRVNVGTAMILGILWDLLLGTTLGIRGMTMAILVYLVAANFKLLRNLALWQQAAIFSALTLLGKLLEFLGEFLVHDVSFNGHFLWAGVLNFILWPWLFLLMRRVRRHWSIR

SEQ ID NO: 9037 - protein, 162 aa, Escherichia coli O157 H7 EC4115 [sequence omitted]

SEQ ID NO: 9038 - protein, 173 aa, Thauera sp. MZ1T
MHPTNRSSRILQPVKLWFVYLSLFVALGLEYIPTGRTPGLPDWVALALAFWCVREPLAIGMGAGFAFGLLMDVGLGAAMGQHALAYVVLAYLANALARRVLWFPAWQQALHVLPLLLLAQAIMALVRLVAGAEFPGWAYFLSSFGSALLWTPLSFLLLLPQYQPDERDDNRPI

SEQ ID NO: 9039 - protein, 162 aa, Shewanella baltica OS223; identical to SEQ ID NO: 8995

SEQ ID NO: 9040 - protein, 158 aa, Acidithiobacillus ferrooxidans ATCC 23270; identical to SEQ ID NO: 9034

SEQ ID NO: 9041 - protein, 163 aa, Thioalkalivibrio HL EbGR7
MSNPRGWVWAIPLTFIVALALTVVPLPDWAAPWRPQWLAMTLIYWSMALPRRIGVGLGWFLGLLLDAATGALLGQHALGFALIAYLSIRMHQRVRVFPLWQQALTVGGLLALHLLLVLWILGMTGRAPGTWLYWAPLVSSMILWPWLFVLLRDVRRRWCLALS

SEQ ID NO: 9042 - protein, 173 aa, Diaphorobacter TPSY uid29975
MIMPKGQQLLLPVNPVFIAASLVAALALNMLPLGRVVWTPDWVMVLLVFWGMHQPQRVGLGVAFLMGLCLDVYQSALLGQHALVYCLLMFGAQYTHRRLLWFGPLLQALQLLPLFFAAHALELLLRVAIGGGILPGFEGLVAPLLEATLWPLASWVLLAPQRRPPDRDENRPL

SEQ ID NO: 9043 - protein, 159 aa, Azotobacter vinelandii DJ
MGEHNGWLIWASYLVGLLLSVAPMPDFMELGRPLWLAMFITYWILSVPQRVSLTLTWLLGLAMDVLYGVLLGQHALTLTLIAFLMLTLQQRVRMFPLWQQSLVLLVVFGLAQLVQLWLNALAGNRPPTLVFLLPALVSALLWPWVFTALRSLRLRFNVN

SEQ ID NO: 9044 - protein, 162 aa, Dickeya dadantii Ech703
MNSYRRHGHGIIWLSFLVAMVLQVMPWPDAIYHYRPSWLTLILIYWVMALPHRVNVGTGFVLGIINDLILGSTLGVRALGLSIIAYLVAFKFQMFRNMALWQQALIVMVLSLILDLLVFWAEFLVSNVSLRPEIFWNSVVDGVLWPWIFLLMRKIRRQFAVQ

SEQ ID NO: 9045 - protein, 162 aa, Dickeya zeae Ech1591
MNSYHRHGHWIIWLSFLVAMVLQIMPWPDELYMYRPSWLTLILIYWVMALPHRVNVGTGFVLGMITDLILGSTLGVRALGLSIVAYLVAFKFQLFRNMALWQQALIVMLLSLVLDLLVFWAEFLVINVSLRPEIFWNSVVDGVLWPWLFLLMRKIRRQFAVQ

SEQ ID NO: 9046 - protein, 162 aa, Pectobacterium carotovorum PC1
MNRYRRHGNWIIWLSFLIAMVLQIMPWPDEIYMFRPSWLTLFLIYWVMALPHRVNVGTGFILGLIMDLILGSTLGVRALALSIIAYLVAFKFQLFRNMALWQQALIVMLLSLLMDLTVFWAEFLVINVSFRPETFWNSVVDGVLWPWLFLLMRKIRRQFTVQ

SEQ ID NO: 9047 - protein, 254 aa, Nitrobacter winogradskyi Nb-255
MAYDPEPPKRSPNPTICRSPPAGGSAPLPDVKSSSSDIAAFVAKARSMSPYASDGRGRLLFALDATMSRQPTWDMACTLQADMFHEAVGIGSLDIRLVYYRGLNECRSSGWIPDSAKLARLMSAIDCRGGNTQIGKVLSHARTEAVASGIKAVVFVGDAMEESVDDLCAKAGELGLLKVPVFMFQEGHDAIAEQAFREIARLTGGAWCRFDPGAASQLRELLRAAAAYAVGGREALRRLSTTVTSATRLLGQMK

SEQ ID NO: 9048 - protein, 238 aa, Nitrosococcus oceani ATCC 19707
MTEKTGKSLRKPSSSSEVDAFLKKVAAMPQIKPGSRHGRLIFAMDATASREPTWDRACHIQAQMFQETASLGGLEIQLCYYRGFKEFSASSWLRHSDALLKQMNTVACRGGYTQIEKALQHTQNETRKQKVNALVFVGDCMEEKMERLCHMAGELGILGVPAFVFQEGYDLVAERAFRQIAQLTQGAYCRFDAASAAQLRDLLNAVAVYATGGRAALENFSQRQGGVTLRLIHQIKKD

SEQ ID NO: 9049 - protein, 246 aa, Rhodopseudomonas palustris HaA2
MPHDPTKSSQRPLTDAADRSVRTGNSSDEIAAFVAKARAMTPGATGARGRLVFALDATMSRQPTWDMACALQADMFREAEAIGSLDIRLVYYRGLSECRASGWISTSDELARLMGRIDCRGGHTQIGRVLSDTRREAIASGVRAVVFVGDAMEESIDDLCAKAGELGMLKVPVFVFQEGYDPVAEQTFREIARLTGGAWCRFDPGAAAQLRELLRAAAAYAAGGRDALLRLARGGGGAALLLGQMK

SEQ ID NO: 9050 - protein, 247 aa, Rhodopseudomonas palustris BisB18
MTRQPTKPPSPPPVSPTGSLPDSKISPSEEIAAFVAKARAMSPHAAGAKGRLVFALDATMSRQPTWDMACSLQAEMFREAAAIGSLDIRLVYYRGINECRASSWISDSAKLATLMAKIDCRAGNTQIGKVLSEARRDAVASGVRAVVFVGDAMEESADDLCAKAGELGLLQVPVFLFQEGHDPAAEQTFRQIARLTGGAWCRFDPGAAGQLRELLRAAAAYAAGGREALQRLSTSTGAAARLLGQMK

SEQ ID NO: 9051 - protein, 246 aa, Rhodopseudomonas palustris BisB5
MPHEPTKSPVRPPTDAADGALRRSNSSDEIAAFVAKARAMAPAATGARGRLVFALDATMSRQPTWDMACALQADMFREAEAIGSLDIRLVYYRGLNECRASGWISSSAQLARLMGRIDCRGGHTQIGRVLSDTRREAVASGVRAVVFVGDAMEESVDELCARAGELGMLKVPVFIFQEGGDAVAEQAFREIARLTGGAWCRFDPGAAAQLRELLRAAAAYAAGGRDALLRLARSGGGAALLLGQMR

SEQ ID NO: 9052 - protein, 231 aa, Nitrobacter hamburgensis X14
MPDIKPSASADIAAFVARARAMSPCATGSRGKLVFALDATMSRQPTWDMACSLQADMFREAAGIGSLDIRLVYYRGLDECRSSGWISDSAKLARLMGAIDCRGGNTQIGKVLSHARSEAVASGIKAVVFVGDAMEESVDSLCATAGELGLLKVPVFMFQEGHDAIAEPGFREIARLTGGAWCRFDPGAAAQLRELLRAAAAYAAGGREALQRLSTTAAGATRLLGQMKLAP

SEQ ID NO: 9053 - protein, 242 aa, Mesorhizobium BNC1
MSDRKPPMETGRKAEVSKPRSENSAIEAFVRQARALATIGKGNGRLILALDATMSRQPTWDLACEIQAEMFDAVGKAGALNVQLVYYRGFGECAASRFVTDTEALKKLMARIDCRGGRTQIGKILAHALKENARGKVNALVFIGDAMEEDVDLLSQRAGELGLKSVPVFVFQEGRDPSATGAFKEIARLSKGAWFRFDRNAGDVLAKLLGAVAVYATGGLPALEARGRPEDRMMIEHLSGKK

SEQ ID NO: 9054 - protein, 83 aa, Psychromonas ingrahamii 37
MQCHSDLPLSPVFVFQEGKNPKVGSIFSQLATLSGGAYCQFDQGSARQLGQLLAAVAVYAAGGKPALESNLLSKDASVRRLLQ

SEQ ID NO: 9055 - protein, 228 aa, Bradyrhizobium BTAi1
MPQAEPSGGDAIAAFVAQVRAMAPATQGARGRLVFALDATLSRQPTWDMACALQAEMFREAAALGSLDIRLVYYRGFSECRATGWISDSSELARLMGKIDCRGGKTQIGKILGEARRNATAEGIRAVVFVGDAMEESVDELCARAGELGLLKVPLFMFQEGHDPAAEQAFREMARLSGGAWCRFDPGAAAQLRDLLRAAAAYAAGGREALRRLAAAESGAALLLGQMT

SEQ ID NO: 9056 - protein, 277 aa, Xanthobacter autotrophicus Py2
MSAHQLLSWRFRAGGPAPWFGGRPGLCVDQEAPMAKTDDKNARLPKAKDTASPVVSGADDVARFLAAARAMPPARPADGRGRLAFALDATGSRQPTWTLACDIQADMFASAAAHGGLDMQIVYYRGQGECRASPFVKDAVTLGALMRRIACQGGLTQIHRVLAHLSREAERSGLKAAVFVGDAMEEDAARLIEAAGQLALRGVRLFMFQEGRDSRVEEVFRTLADVTSGAYCRFDAHAPDELRQLLSAVAAYAAGGRLALANRRDAGARLLIAALGR

SEQ ID NO: 9057 - protein, 246 aa, Rhodopseudomonas palustris TIE 1
MSREPTSTPSQTSVRDSGAATPAPSTSAEIAAFVAKARAMAPNAAGARGRLVFALDATMSRQPTWDMACALQADMFREAEAIGSLDIRLVYYRGFNECRASNWISSSAELARLMGKIDCRGGHTQIGRVLADARKEAIAAGVRAIVFVGDAMEEQADELCAKAGELGMLKVPVFVFQEGVDPVAEQTFREIARLSGGAWCRFDPGAAAQLRELLRAAAAYAAGGREALQRLAASGGGAALLLGQMR

SEQ ID NO: 9058 - protein, 233 aa, Methylobacterium sp. 4-46
MGARSGPPAPADPAAVAAFLDRARRLAPAATAAPRLIFALDATMSRQPTWDLACRLQAGMFEATAGLGGLAVQLVYFRGLGECRASRFVADARALTDLMAGIACRGGQTQIARVLRHARAEAAKGPVKALVLVGDAVEEDLDGLCALAGELGLLGVPAFCFREGEDPQALRGFSEIARLSGGAHAPFDRAAPATLAGLLRAVAVYAARGLDGLRLAAREDAQARRLLGAMTPR

SEQ ID NO: 9059 - protein, 237 aa, Methylocella silvestris BL2
MQRQKDGRDLVGADRNSKSEIDAFLSETEKRPVIATGRGRLIFALDATMSRQPTWDLAQHLQAHMFETAAAHGGLDVQLVFYRGFNECKASRFLNGGKALAAAMTRITVAAGHTQIGKVLRHVLEEAGNAPVRALVFIGDAMEERADDLADLAGRLGLMGVKAFVFQEGADRVAERAFRQIALLTGGAYATFDAGAAQRLAALLSAAAAYAAGGRQALELEAADKGAAAMLLLSQMS

SEQ ID NO: 9060 - protein, 233 aa, Methylobacterium nodulans ORS 2060
MGERSVPPVPTGEAAVAAFLGEARRLAPATPAAPRLIFALDATMSRQPTWDLACRLQAEMFAATADLGGLAVQLVYFRGFSECRASRFVADPRALTGLMTGIHCRGGLTQIGRVLRHARAEAGKGPVKALVLVGDAVEEDLDGLCAVAGELRLLGVPAFCFQEGGEPQAATGFAEIARLSGGAHARFDRDAPATLAGLLRAAAVYAARGLDGLRLAAREDAVARRLLGAMTPR

SEQ ID NO: 9061 - protein, 153 aa, Frankia CcI3
MTTAPPGGPAGPRAPELVAPRTPGLSRRRGKPGSAKARTNFELYAWVFMRVSGLLLFFLVLGHLFIMNILDGGVQRVNFGFVAGRWASPFWRTWDLVMLLLAELHGTNGLRTIINDYAGRPQTRFWLKTLLYTSAFLVVALGTLVIFTFDPDI

SEQ ID NO: 9062 - protein, 125 aa, Deinococcus geothermalis DSM 11300
MIRARTLTDARQQSHSNAELNWWIFMRISGLILVFLILGHIYMTFIQVSESDATFDAVVAKLQNPAWKFYDWLILLLAMLHGVNGARYSIEDYVRSRPNRAWVKGIFYTICAVIFLLGTVGLFSI

SEQ ID NO: 9063 - protein, 159 aa, Mycobacterium MCS
MSPAENPYDHVTDRGGPAPVLQRSHDRPPSLDNPRAPKRAGGMPNFEKYAWLFMRFSGMVLVFLALGHLFIMLMWDNGVYRIDFNYVAQRWSSPFWQTWDLLLLWLAQLHGGNGLRVIISDYARKDSTRFWLNSLLALSMIFILVLGTYVLLTFDANIS

SEQ ID NO: 9064 - protein, 164 aa, Arthrobacter FB24
MTATIQSPRSGKDGGKPGAGLIAPKYRRSGASKGNFEMAAWLFMRLSGVVLVVLIFGHLFVNLMVGEGIHAIDFGFVAGKWADPFWQFWDLAMLWLAMLHGTNGVRTIINDYAEKDSTRFWLKIVLYAATAVIIILGTLVIFTFNPCPLDVNGVPLPGGFCPAA

SEQ ID NO: 9065 - protein, 159 aa, Mycobacterium KMS; identical to SEQ ID NO: 9063

SEQ ID NO: 9066 - protein, 163 aa, Mycobacterium vanbaalenii PYR-1
MSSGKKMAENPYDHISDRGGPAPVMQRSYDRPAGLDNPRSPRRAGGMPNFEKYAWLFMRFSGIVLVFLALGHLFIMLMWENGVYRIDFNYVAERWSSPFWQTWDLLLLWLAQLHGGNGMRTIIADYSRKDSTKFWLNTLLALSMAFTLVLGTYVLLTFDATIS

SEQ ID NO: 9067 - protein, 159 aa, Mycobacterium JLS
MSPAENPYDHVTDRGGPAPVLQRSHDRPPSLDNPRAPKRAGGMPNFEKYAWLFMRFSGMALVFLALGHLFIMLMWDNGVYRIDFNYVAQRWSSPFWQTWDLLLLWLAQLHGGNGLRVIISDYARKDSTRFWLNSLLALSMIFILVLGTYVLLTFDANIS

SEQ ID NO: 9068 - protein, 167 aa, Mycobacterium gilvum PYR-GCK
MTQASRPASGRAENAYDHISDRGGPAPVMQRSFDRPAGLDNPRAPRRSGGMPNFEKYTWLFMRFSGIVLVFLALGHLFIMLMWENGVYRIDFNYVAQRWSSPFWQTWDLLLLWLAQLHGGNGMRTIIADYTRKDSTKFWLNTLLALSMAFTLVLGTYVLLTFDASIS

SEQ ID NO: 9069 - protein, 144 aa, Mycobacterium tuberculosis F11
MSAPVRQRSHDRPASLDNPRSPRRRAGMPNFEKFAWLFMRFSGVVLVFLAIGHLFIMLMWDNGVYRLDFNFVAQRWASPFWQTWDLLLLWLAQLHGGNGLRTIIDDYSRKDTTRFWLNSLLVLSMLFTLMLGTYVIVTFDPNIS

SEQ ID NO: 9070 - protein, 162 aa, Chlorobium phaeobacteroides BS1
MSQHYENEGSAASRSKAFVWLMQRVTGVGLVLFLVLHFWVQHMPTGFLATAGEYSEILKTLSEASPEVVDAIADGKIKEALPGEHVITYSKVLERLRTPLWRIIDILLLLFALLHGMLGLMNVLGDYMKRVRLRKAVVFCCWAVTLFLAGQGIVVIMAVGMK

SEQ ID NO: 9071 - protein, 165 aa, Prosthecochloris aestuarii DSM 271
MNQSLHETPPVTISSKIEAFGWVMQRFTGLGLVLFLALHFWVQHMPNGYLATATEYNDIVAEFATKSPEYAEAIADGHIKEALPEEHVITYSSVAARLANPLWKAIDIMLLLFALAHGLNGLNNVLVDYVQRAALRKALFAGSLAVCLFLSVQGIASILAAGSGA

SEQ ID NO: 9072 - protein, 153 aa, Arthrobacter chlorophenolicus A6
MTATIESPRSGRIAPQYRRNGGSRGNFEMIAWLFMRLSGVVLVVLIFGHLFVNLMVGEGIHAIDFGFVAGKWADPFWQFWDLAMLWLAMLHGTNGVRTIINDYAEKDSTRRWLKTVLYSATVVIIVLGTLVIFTFDPCPVVDGVPLPGGFCPA

SEQ ID NO: 9073 - protein, 138 aa, Actinosynnema mirum DSM 43827
MSELALDRPRTPRRPAARRNNFELYSWLFMRLSGVALLVLVLGHLFIMNILDGGVHRINFGFVAGRWASPFWQIWDLAMLWLAQIHGGNGLRTVINDYARKDATRFWLKMLLYVSMVLIIVTGTYVVFTFDPGIATTN

SEQ ID NO: 9074 - protein, 152 aa, Beutenbergia cavernae DSM 12333
MATIDDGVIANPRARYTRRLRTPGNSELWAWIFMRASGVLLIVLIFGHLFVNLLVGDGVGAIDFAFVGGKWASPFWQVWDLLMLWLAMIHGTNGVRTIINDYAERDVTRVVLKSLLYLAFVVTVVLGTLVIFTFDPCPTGAAAHLLPSFCTA

SEQ ID NO: 9075 - protein, 150 aa, Brachybacterium faecium DSM 4810
MTSTTSIPDPSTRYRRTGQRGLNSEMLSWMFMRASGVLLVILVFGHLFVNLWLGQGVKGIDFAFVGGKWASPFWQVWDLLMLWLGLIHGGNGVRTIINDYARGDRLRLVLKGLLYFAVVVTIILGTLVIFTFDPCPTGAEPSLLPSFCEG

SEQ ID NO: 9076 - protein, 159 aa, Micrococcus luteus NCTC 2665
MSTTAETTIAAPRSRRLDPTYTRDGGGRGNFEMLAWLFMRISGVFLVVLIAVHLTTNLLVGDGIHAVDFGFVAGKWAHPLWQFWDLALLWLAMLHGANGVRTIINDYTRRGTGRFWLTMILYIATAVIIILGTLVIFTFDPCMVDASGALLEGSPAFCG

SEQ ID NO: 9077 - protein, 151 aa, Catenulispora acidiphila DSM 44928
MAQSTHVSLEAPRTGNPGRSQRYRSRKGPGKVTRGNFELYSWLFMRASGVLLVFLVLGHLFIMMVTDGGVEKIGFAFVAGRWASPWWQFWDLLQLWLAMIHGSNGMRTVINDYADKDRTRAILKGLLYTAAVLTIALGTLVIFTFDPNIKG

SEQ ID NO: 9078 - protein, 138 aa, Saccharomonospora viridis DSM 43017
MAEALTLDKPRSPRRPAARRSNFELYSWLFMRISGLLLVVLVLGHLFIMNILDGGVHRINFAFVAGRWSSPFWQFWDLTMLWLAMIHGGNGLRTVIEDYARKESTRFWLKMVLYVATVVILLLGTLVIFTFDPNIPAD

SEQ ID NO: 9079 - protein, 146 aa, Jonesia denitrificans DSM 20603
MTTQIDNPRAPYRRQKITRSNFEMWGWLFMRGSGVILVVLIFGHLFVNLMVGEGVSRIDFAFVGGKWTSPFWQTWDLLMLWLAMIHGTNGVRTIINDYSERHITRLILKLALYSAFILTVVLGTLVIFTFEPCPANAPADLLPSFC

SEQ ID NO: 9080 - protein, 143 aa, Nakamurella multipartita DSM 44233
MTAAFDPPATRGIVAPRAPRKRVTGRRSSFEMYSWMFMRLSGIVLVVLVLGHLLIMNVLDGGVHRINWGFVAGRWASPFWQIWDLLMLWLAELHGANGLRTVINDYARKDGTRFWLQLLLLISVVLTLAVGTLVIFTFDPTMS

SEQ ID NO: 9081 - protein, 272 aa, Staphylococcus epidermidis RP62A
MKDNNEVLKLFIVSDSIGETAQRMIHATLTQFPDLTQVEIKKFPYIKDEQEFLNVLQLAKEQNAIVATTLVSESFNALGHQFANEHQIPYVDYMSELISIIKQHTHAKPLMESGALRKLNDEYFKRIEAIEYSVKYDDGKHFTDIGEADALIVGVSRTSKTPLSMYLANKGYKIANIPLVPEVAIPDNVFQQKNLKVFGLTASPNYIANIRRNRAETLGLSSESNYNSLERIKKELSYAEEVFRKLNATVINTEYKSIEESAFYIEKFLAKR

SEQ ID NO: 9082 - protein, 294 aa, Moorella thermoacetica ATCC 39073
MGNRAGAHFCLASGLRLPSKGGVTIGVIYVISDSLGETAEYVARAAASQFDGGGLDIRRVPYVTDLDHLEEVVNEAAQEQGIIAFTLVLPDLKKKLLELAAARGLEAVDLLGPLMDAITRVTGGRPRLEPGLIRRTDEDYFRKMEAIDFAVKYDNGKDIRGLSHADLVLIGVSRTSKTPVCMYLAHKRLRAANLALVPEVPLPGELLNLPPEKIIGLTIDAGLLYQIRQERLKTLGLPGPAGYATRERIEEELAYARRVMDQLGCPVIDVTNKAVEETAGKILQIYYRRERNGK

SEQ ID NO: 9083 - protein, 273 aa, Syntrophomonas wolfei Goettingen
MSNHLPGVFIVSDSIGETAEMVVRAAASQFNSGNMEIRQVPNISDTETLEEIINQAAASNFIIAYTLVINELADFLKMEARKKGVICVDVLGPVIEAFKSVSDIEPRREPGLLRKVDEMYYRRVEAVEFAVRYDDGKDPRGVMQSDIVLVGVSRTSKTPLSMYLAHKRIKVANVPLVPEVEPPEEIFQVEKGKVIGLVINPEQLNQIRTERLKTLGLKGQASYANLERILEEMEYAQEIMKRLGCPVIDVTNRAVEETASKILEIYYRRLSHV

SEQ ID NO: 9084 - protein, 286 aa, Desulfotomaculum reducens MI-1
MAKGLEEGFTIIAPKDDHPVVYIVSDSIGETAELVAKAAVSQFNGGNVEIRRVPYVNDPQDIVDIVDEAQGQNCIIAFTLVLPELREVLVREADKHNIPTVDIMGPFLDALTLITAAPPKLEPGLVRKLDEEYFRKVEAIEFAVKYDDGKDPRGIQRADLVILGVSRTSKTPLSMYLAHKRIKAANVPLVPEVAPPQEIFSLSSHKVIGLTIKPQQLNVIRTERLKTLGLTSNADYASHERILKELDYAESIMKRVGCPVIDVTNKAVEETASKVLEIYYRGERYR

SEQ ID NO: 9085 - protein, 282 aa, Gluconacetobacter diazotrophicus PAl 5 JGI
MSSHSIVLHLVSDATGQTLDSVVRASVAQFDHAEITYHRWNLIRTRAQLRRVLEGIERDPGPVLSSVVDPRLLHELTVGCAHIGVRLTNVLDPVTAVLQDELGEKAVGRPGGQYVMDDAYFRRIDAMHFVLAHDDGQEIAGLAQADVVLVGISRASKTPTSFYLANCGVKAANVPLIPDLPLPGELLHLPRPVVGLTIDPDVLISIRRHRLDIMADRGKDLLMRRDNPYIDPEQVEEEVRWARRLCVRHGWPLVDVSRRSIEETSAAVMELMADWQERTRAP

SEQ ID NO: 9086 - protein, 277 aa, Kytococcus sedentarius DSM 20547
MTTQHIEFHVVADSTGDTAARVARATAAQFPDIETHIVRHPRITTEDTLRSVMGRIENDAHQVVVFSTIVDDRLHALVHELAQQAHLEHVDMLGPALEAVERVADRQAEHKVRPVGISADYFTRIAAMEYAVANDDGNMGQTLDQADIVLIGVSRSGKTPLSMYLGYLGYKTANIPLVNGIEPPAELFDVPRWKVVGLVIDPERLQDIRSRRVRSLGGRQGRDGYADLMKIYEELDHADQIFRRVGCPTINTTELALEESAGRVIELVENRRATLRG

SEQ ID NO: 9087 - protein, 296 aa, Eggerthella lenta DSM 2243
MDEFIAYGSSTELPTIHVISDSVGLTAQAVARAAAAQFGVTNPVIEVLPKVRTFEEIKEFIDEHSAVHKRNTGDGRMLVFYTLVDRDLSRQLAEYAGGRDDIVAVDLVTDAIGAIAHMTGKQPSTKPGGLHVADQYYFRRIEAIEFTIAHDDGRNPQELHQADIVLLGVSRSSKTPTSIYLSQQGYKVANIPLDPTTEPPAELEQVDRTRLFGLMTTPEVLIGIRQRRLGRASAVASRYADPEYVYRDLEDARALMRKLGCIVIHTENRAVEETAQEILRYYERAHPPSADMIGSA

SEQ ID NO: 9088 - protein, 291 aa, Cryptobacterium curtum DSM 15641
MIPTINIISDSVGTTAQAIARAAASQFGETEPIIELLPNVRTFEEVETFLQKRLDETRRRTGSPEMIVFYTIVEAEVTRQLKEYLAFHPEIHAVDLITDAVDAISQVSGREPMVVPGELHITDERYFHRIEAIEYTIAHDDGRNPQDLPSADIVLLGVSRCGKTPTSIYLAQEGYRVSNVPLDLVSAPPAEIHKVDPSRLFGLVTTPDVLVDIRRRRLGNALAVAGDYADREKVEQDLEKARSLMRQLGCFVIHTENRAVEETAQEIMRYYEVAHPRKGSLRGEGDLQTVE

SEQ ID NO: 9089 - protein, 271 aa, Anaerococcus prevotii DSM 20548
MDIYIISDTAGLAISEIVHFSLSKFDINSNIIIKSQVKEIDELSDLLASIKTDNIIIYHSFQDSKMSAYIKTFAQTKEIETIDLMAYSINSLSKILNQKPLDNPNFINAYDSNHMRRLDALDFAIKYDDGADFRGIKFCDIAIIGVSRSSKTPLSMYLASKGLRVSNIPLIVDSKAPRELFEIDPRRIIGLTIDKGRLKSVRDERLKSLKLSSDSIYSSRERIDAELKYADDLMKDLGCFVIDVTYRSIEETSDIIINYLNKNKLLERKEK

SEQ ID NO: 9090 - protein, 307 aa, Slackia heliotrinireducens DSM 20476
MHEEGCALPGEPSIQMGSYHEGFPTIHIVSDSLGFTAQSLARAAAGQFGVTDPAFEIFSRITDAETAGKVLLKHRAEQANNGINEPMVVFFSFVDAEESAKLKRICEKHDIYAVDMMTEPIAMLEKASGLTSSRQPGLFRQTDENYFRRIAAMEFTINHDDGRNYQDLPKADIVLLGVSRSSKTPISVYMGMEGYRVANVPLAVGTEPPAEVFECDPTRIFGLMTTPDVLVSIRQRRLGNAGKGATGAAGQYAQRDYVYDDLESARALMRKLGCIVIHTENKAVEETAQEILRYYELTHPARKPPIE

SEQ ID NO: 9091 - protein, 132 aa, Atopobium parvulum DSM 20469
MSTLDIDNNNTLGDGLPIIYVLSDSRGETGAAVVKAAAAQFGDDSVEIVRVPNIHSVEDVRTYFNEREDEDRPRAVFHTFADGSLRREIRRELDQRLIPSIDLLGPAVNVISTLTGEEPSHAIGAFFEGVTR

SEQ ID NO: 9092 - protein, 277 aa, Desulfotomaculum acetoxidans DSM 771
MSAEKKGRTVIYIISDSVGETAELVARAAASQFDGGRVEIHGVPYVQNPEEIPEIVKMAAEDESIIAFTLVMPHLREVLIREAQLHKVVIVDIMGPMLDALTKAEGISPRLEPGLVRKIDDEYFRKVEAIEFAVKYDDGKDPRGIMRADIVVIGISRTSKTPLCMYLAHKRIKAANVPLVPEAAPPEELFKLPSHKIVGLTIKPSQLNEIRTERLKTLGLTSDADYASINRIIKELEYAQDIMRRVGCHVIDVTNKAVEETASKVMELYYRGERSKQ

SEQ ID NO: 9093 - protein, 264 aa, Porphyromonas gingivalis W83
MMSETKISPLAWVDPHAEIGVGVEIGPFAVVEAGAKIGDGSILHPHAVVRYGSTLGKGCEIHPNAVIGGVPQDLKFQGEDTTAILGDYTIVRECATVNRGTASRGTTVVGSHCLLMAYSHIAHDCVLGDHIIVGNASQIAGEVEIDDHAIISGGVLIHQFVRISQHVMIQGGSRLSKDIPPYVLVGRDPLVYCGINIVGLRRRNFTNEQIFLINDIYRTLYQRGLNNSDAIDIIQQEYADCHEKELILDFIKSSKRGIVRGTME

SEQ ID NO: 9094 - protein, 259 aa, Cytophaga hutchinsonii ATCC 33406
MNQPLAYIHPEAKIAQNVVIEPFTTIHKNVEIGEGTWIGPNVTIMEGARIGKNCKIFPGASISTLPQDLKFEGEETLTIIGDNTVIRECVTISRGTKDKFKTVVGSNCLLMAYVHIAHDCIVGDHCILANAVQVAGHAIIDDYAIISGASAIHQFCKIGAHVMVSGGSLVRKDVPPYTKAGREPLSYCGINSVGLRRRGFSNEKINEIQDIYRVIYLRGFNNSQALNHLEVNFAPSKELDEIVNFMRNSDRGIMKGIGD

SEQ ID NO: 9095 - protein, 261 aa, Flavobacterium johnsoniae UW101
MNQPLAYVHPGAKIAKNVVIEPFTTIHNNVVIGDGTWIGSNVTIMEGARIGKNCNIFPGAVISAVPQDLKFGGEDSLAIIGDNCTIRECVTINRGTIASGQTILGNNCLVMAYAHIAHDCEIGNNAIIVNGVALAGHVVVGNHAVIGGLAAIHQFIHIGDHAMISGGSLVRKDVPPYTKAAKEPLSYVGINSVGLRRRGFSTEKIREIQEIYRILYQKNYNTTQALSIIEAEMEATPERDEILDFIRNSSRGIMKGYSGNY

SEQ ID NO: 9096 - protein, 262 aa, Opitutus terrae PB90 1
MSSKIHPTAIIEPGAQLGSDVEIGAYAFVGTGTTLGDGTRLHHHASVEGNTVLGKACEVYPYACIGGKTQDLKYKGGNPGLRIGDRNVFREYVTVHAATKDGENTIIGNGNNLLALSHVAHDCVLGDGIVMSNNAGLAGHVTVENHVVIGANAGVHQFCRLGAFVMLSAYAKLVQDVPPFFIADGAPATVRTFNKVGLERNGFTPEQIERVKTIFRMLYRGGLNRTQALEQLAAHEQAASAEFQRVLEFAKKSERGMAAGGR

SEQ ID NO: 9097 - protein, 258 aa, Candidatus Amoebophilus asiaticus 5a2
MIQSLNYIHPQAQLGENVSVGPFTTISENVIIGEGTWIGPHVTILPGARIGRHCQIFPGAVIATIPQDLKFQGEETTAEIGDYTIIREYVTISRGTLAGPTTTIGNHVLLMAYVHVAHDCIIGDHCVLANAVQLAGHVELGTHVKIGGTAALRQFVKVGAYAMIGGGSLVKKDIPPFVKVAREPLKYCGLNIVGLKRLGFTAYQLQTIQLIYRYIFQQDLPLAEALTRIEQEIPSCWEKDTILKFINNASLGIVKNTI

SEQ ID NO: 9098 - protein, 264 aa, Capnocytophaga ochracea DSM 7271
MIQPLAYVHPDAKIAKNVVIEPFTTISKNVEIGEGTWIGPNVTIMEGARIGKNCKIFPGAVISAIPQDLKYKGEETTTHIGNNTTIRECVTINKGTVDRMRTVVGNNCLIMAYSHIAHDCIVGDNCIFSNGTTLAGHVTVGDCAVMAGMTAVYQFCSIGSYAFVTGGSLVGKDVPPYVKAARNPLSYVGVNSIGLHRRGFTTEKIREIQDIYRVLFQKKLSTSHALDYIEAEMEATVERDEILQFVRRSQHGIMKGYHGELIKE

SEQ ID NO: 9099 - protein, 261 aa, Pedobacter heparinus DSM 2366
MIQPLAYIHPQAKIADNVVIEPFAVIHKDVEIGEGTWIGSNVVIMDGARIGKNCRVFPGSVISGVPQDLKFAGEITTAEIGDNTTIRECVTINRGTKDKWKTVIGSNCLIQAYSHIAHDCEVGDFCIFSNSTTLAGHITIGNYVVLAGLVAIHQFVKVGSHAFVTGGSLVRKDVPPYVKAAREPLSYAGINSVGLRRRGFSSEKINEIQEIYRVLFVKHNNVTKALDMIEAEFKPTEIRDEIVDFIRNSNRGVMKGFGSGS

SEQ ID NO: 9100 - protein, 270 aa, Dyadobacter fermentans DSM 18053
MTQSLAYIHPDAKIAQNVTIEPFAMIHADVEIGEGSWIGSHAVINSGARIGKHCKIYPGAVVSATPQDLKYNNEYTLTIVGDNTTIREYATISRGTEEHWKTVVGSDCLIMAYAHVAHDCRVGNNVIIGNNVQMAGHVHVGDWAIVSALSAVHQFVKIGVHAFVSGASLVRKDVPPFTKAAREPISYVGINSVGLRRRGYTNEQIIDIQNIYRFVYMKGLNNAEALQKIELEMAPSDERDEIINFIRNSERGIMKSPFQTTGASETEAQS

SEQ ID NO: 9101 - protein, 264 aa, Chitinophaga pinensis DSM 2588
MIHPLTYIHPDAKVAPNVKIDPFTVIHKNVEIGEGTWIGSNVTIMEGARIGKNCRIFPGSVISAIPQDLKFAGEDTTTEIGDNTTIREYVTINRGTKDKWKTVIGKNCLIMAYSHIAHDCEVGNSCVFSNSTTLAGHITVGDYVVLAGMVAVQQFCKIGDHAFVTGGSLVRKDVPPFVKAAREPLSYVGVNSIGLKRRGFSLEKINHILDIYRVIFVKGYKLSKAISIIEAEYPATDERDEILSFIRESGRGIMKGYTSLAGDE

SEQ ID NO: 9102 - protein, 100 aa, Clostridium perfringens SM101 uid12521
MITTKQRAYLRGLGAKLTPIFQIGKNGIEDNFLKQVDDALEAREILKINVLENSGLETREASNFICERLGCEGVQSIGNKIVLYRASKNNPKIELPKKGK

SEQ ID NO: 9103 - protein, 100 aa, Clostridium perfringens ATCC 13124; identical to SEQ ID NO: 9102

SEQ ID NO: 9104 - protein, 96 aa, Clostridium thermocellum ATCC 27405
MLTGKQRSYLRSLANSIEPIFQIGKGGINDNMIKQFNEALEARELIKVAVLKNAMVDTKEVCHEVASLVGAEVVQVIGNKFVLYKESKENKVIELP

SEQ ID NO: 9105 - protein, 96 aa, Clostridium phytofermentans ISDg
MTSKQRAYLKGLAMNIDPIFQVGKASISPELTTGISEALEKRELIKISVLKNCLDDPREIASVLSERTHSEVVQVIGKKIVLYRESKEKKKIELPK

SEQ ID NO: 9106 - protein, 97 aa, Desulfitobacterium hafniense DCB 2
MLTGKQKGFLRSLGNEMDPILQIGKGGVTEAVIAQTDETLEARELIKGRVLPNSMEDVQSAAAELAERTSAELVQVIGRNFLLYRESKKKPMIDLPR

SEQ ID NO: 9107 - protein, 96 aa, Halothermothrix orenii H 168
MLTGKQRSYLRSEANNLNPVIHIGKDGITPSLLNQVDAALDDHELIKCRVLKNSLGEPRSFADEISSQLNCDVVQVIGNVFVLFRRNEEEPIYILP

SEQ ID NO: 9108 - protein, 96 aa, Clostridium cellulolyticum H10
MLTGKQRSYLRSIANNLHPIFQVGKGGVSDNLIKQFSDALEARELIKATVLKNAECDTKTICEEIAEQTNSEVVQVIGSKFVLYRPSEKNSVIELP

SEQ ID NO: 9109 - protein, 94 aa, Anaerococcus prevotii DSM 20548
MLTGKQRAKLKQESHDFKPVINIGKFSVTDELIKAIDEALEARELIKIKILNNNMDDQEEIIDTIIEKTGSEFISHLGSIFTIYRKNNDNKYEL

SEQ ID NO: 9110 - protein, 270 aa, Pseudomonas syringae tomato DC3000
MLPYPQIDPVAVAIGPLQIHWYGLMYLVGIGGAWLLASRRLNKFDPTWTKEKLSDLIFWLAMGVIVGGRLGYVLFYDLSAYIANPLLIFEVWKGGMAFHGGFVGVMIAAWWFGKRNGKSFFQLMDFVAPLVPIGLGAGRIGNFINAELWGKPTDVPWAMVFPPFSDPAQLARHPSQLYQFALEGVALFIILNLYARKPRPTMAVSGMFALFYGIFRFVVEFVRVPDAQLGYLAWGWVTMGQILSLPMIIAGLFLIWLAYKRDPAASKAAV

SEQ ID NO: 9111 - protein, 270 aa, Pseudomonas syringae pv B728a
MLPYPQIDPVAVAIGPLQIHWYGLMYLVGIGGAWLLASRRLNKFDPTWTKEKLSDLIFWLAMGVIVGGRLGYVLFYDLSAYIANPLLIFEVWKGGMAFHGGFVGVMIAAWWFGKRNGKSFFQLMDFVAPLVPIGLGAGRIGNFINAELWGKPTDVPWAMVFPPFSDPAQLARHPSQLYQFALEGVALFIILNLYARKPRPTMAVSGMFALFYGIFRFVVEFVRVPDAQLGYLAWGWVTMGQILSLPMIIAGLLLIWLAYKRDPSASKAAA

SEQ ID NO: 9112 - protein, 274 aa, Saccharophagus degradans 2-40
MNYPDIDPIALSIGAFELFGFEIGPINVHWYGIMYLCAFLGAWGLGRYRASKPGACLTKAQVEDLIFYGAVGVVVGGRLGYVFFYNFSAFLADPVWLFKVWEGGMAFHGGLIGVAVAMLLFARKVNRNFFDVMDFTAPLVPIGLGFGRIGNFIGGELWGRETTVSWGMVFPKDELGLVRHPSQLYQAFLEGVVLFAILFWFSAKPRPRAAVSALFLIVYGCQRFAVEFVRQPDEHIQFDLFDWVTRGQILSLPMIAVGLIVFAWAYRTKPGATR

SEQ ID NO: 9113 - protein, 290 aa, Serratia proteamaculans 568
MTNSYLAFPKFDPVIFSIGPVSLHWYGLMYLVGFVFAMWLAVRRANKPGSGWTKDEVENLLYAGFLGVFVGGRVGYVLFYNLPLFMENPLYLFKVWDGGMSFHGGLMGVILVMFWFARRTKRTFFQVSDFIAPLIPFGLGAGRLGNFINGELWGRVTTDTPWAMLFPSSRAEDVALAAADPKLLPILNQYGVLPRHPSQLYELLLEGVVLFIILNLFIRKPRPMGAVSGLFLIGYGAFRIIVEAFRQPDAQLGLFDGVISMGQILSVPMVVAGIIMMIWAYRRRPQQQLS

SEQ ID NO: 9114 - protein, 261 aa, Coxiella burnetii RSA 331
MLYYPHIDPVAFRLGPLKVHWYGLMYLVGFAMAWGLALYRARDPKRHWTAQQVGDLIFYGALGLIIGGRLGYMLFYDFSNFIANPLTLFQVWRGGMSFHGGLIGVIVTTWIFSRRTHKRWMDVTDFVVPLVPLGLAAGRIGNFINGELWGRVTTVPWGMVFPNAGPLPRHPSQLYEFLLEGVLLFIVIWWFSAKLRPRFAVSSLFLLCYGLFRFTAEFFRQPDPQLGFVAFGWLTRGQELSLPMIIIGGFALWWAYRHKER

SEQ ID NO: 9115 - protein, 290 aa, Yersinia pestis Angola
MSNSYLAFPKFDPVIFSIGPVSLHWYGLMYLVGFVFAMWLAVRRANKPGSGWTKEEVENLLYAGFLGVFIGGRVGYVLFYNLPMFLDNPLYLFKVWDGGMSFHGGLIGVICVMLWFARRTKRNFFQVADFIAPLIPFGLGAGRLGNFINAELWGRVTTDTPWAMLFPTSRNTDIAIVAADPAKWQAIFNQYGVLPRHPSQLYEMILEGVVLFIILNVFIRKPRPMGSVSGLFLIGYGTFRIIVECFRQPDEQLGLFEGMISMGQILSVPMILAGIIMMIWAYRRPTQKLS

SEQ ID NO: 9116 - protein, 290 aa, Yersinia pseudotuberculosis YPIII; identical to SEQ ID NO: 9115

SEQ ID NO: 9117 - protein, 291 aa, Salmonella enterica serovar Heidelberg SL476
MTSSYLHFPDFDPVIFSIGPVALHWYGLMYLVGFVFAMWLAVRRANRPGSGWTKNEVENLLYAGFLGVFLGGRIGYVLFYNFPLFLDNPLYLFRVWDGGMSFHGGLIGVILVMIIFARRTKRSFFQVSDFIAPLIPFGLGAGRLGNFINGELWGRVDPDFRFAMLFPGSRAEDIALLPSHPQWQPIFDTYGVLPRHPSQLYELALEGVVLFIILNLFIRKPRPMGAVSGLFLIGYGAFRIIVEFFRQPDAQFTGAWVQYISMGQILSIPMIIAGAIMMVWAYRRRPQQHVS

SEQ ID NO: 9118 - protein, 291 aa, Salmonella enterica serovar Schwarzengrund CVM19633
MTSSYLHFPDFDPVIFSIGPVALHWYGLMYLVGFVFAMWLAVRRANRPGSGWTKNEVENLLYAGFLGVFLGGRIGYVLFYNFPLFLDNPLYLFRVWDGGMSFHGGLIGVILVMIIFARRTKRSFFQVSDFIAPLIPFGLGAGRLGNFINGELWGRVDPNFRFAMLFPGSRAEDIALLPSHPQWQPIFDTYGVLPRHPSQLYELALEGVVLFIILNLFIRKPRPMGAVSGLFLIGYGAFRIIVEFFRQPDAQFTGAWVQYISMGQILSIPMIIAGAIMMVWAYRRRPQQHVS

SEQ ID NO: 9119 - protein, 291 aa, Salmonella enterica serovar Agona SL483; identical to SEQ ID NO: 9117

SEQ ID NO: 9120 - protein, 291 aa, Salmonella enterica serovar Dublin CT 02021853; identical to SEQ ID NO: 9117

SEQ ID NO: 9121 - protein, 287 aa, Dickeya dadantii Ech703
MTTSYLVFPQFDPVIFSIGPAALHWYGLMYLVGFVFAMWLAVRRANKPGSGWTKDEVENLLYFGFLGVFVGGRLGYVLFYALPLFLDNPLYLFRVWDGGMSFHGGLVGVITVMAWFAHRTRRTFFQVSDFIAPLIPFGLGAGRLGNFINGELWGRVSTDTPWAMLFPGARGEDMALAASHPEWQPIFAQYGMLPRHPSQLYEMLLEGVVLFIVLNVFIRKSRPMGSVSGLFLVGYGIFRIIIEFFRQPDAQLGLFSGISMGQILSVPMVLIGLLMMLWAYRRQPVRQ

SEQ ID NO: 9122 - protein, 289 aa, Pectobacterium carotovorum PC1
MMTTSYLAFPQFDPVIFSIGPLALHWYGLMYLVGFVFAMWLAVRRANKPGSGWTKDEVENLLYMGFLGVFVGGRLGYVLFYAFPSFLENPLYLFKVWDGGMSFHGGLMGVICVMLWFAHRTKRHFFQVADFIAPLIPFGLGAGRLGNFINGELWGRVTTDTPWAMLFPGSRSEDMMLAVSNPQWQAIFNQYGMLPRHPSQLYQMMLEGVALFIILNLFIRKSRPMGSVSGLFLIGYGTFRIITEFFRQPDAQLGLFGDLFSMGQILSLPMVIAGILMMVWAYRRQPVQQ

SEQ ID NO: 9123 - protein, 183 aa, Rhodoferax ferrireducens T118
MRCLTNFNPSFKDHSMIKVGDQLPATTLMEFSEVEGGGCSLGPNPVDVAKASAGKTIALFALPGAFTPTCSAKHVPGYIQHFDALKAAGVDEIWCVSVNDAFVMGAWARDQKTNGKVRMLADGDAAFAKATGLTLDLTGKGMGLRSNRYSMLVKDGKVVTLNIEAPGKFEVSDAATLLAQAKA

SEQ ID NO: 9124 - protein, 168 aa, Polaromonas JS666
MIKVGDTLPAATLMEFSEVEGNGCSIGPNPVDVAKVTAGKTIALFALPGAFTPTCSAKHVPGYVEKAAEFKAAGVDEIWCVSVNDAFVMGAWARDQKTDGKVRMLADGSADFAKATGLTLDLTARGMGLRSNRYSMLVKDGKVMSLNVEGPGKFEVSDAATLLAQAKA

SEQ ID NO: 9125 - protein, 168 aa, Acidovorax avenae citrulli AAC00-1
MIKIGEALPAVTLMEYSEVEGGGCSIGPNPVDVAKASAGKTIALFAVPGAFTPTCSAKHVPGYVEQAEAFKAAGVDEIWCLSVNDAFVMGAWARDQKTDGKVRMLADGDAAFAKATGLTLDLNGKGLGLRSNRYSMLVKDGKVASLNIEAPGKFEVSDADTLLAQARG

SEQ ID NO: 9126 - protein, 185 aa, Acidovorax sp. JS42
MGPADPAGALQPSKEILMIQVGDTLPAITLMEYSEVEGNGCSLGPNPVDVQKAAAGKTIALFAVPGAFTPTCSAKHVPGYVEQAGALKAAGVDEIWCLSVNDAFVMGAWARDQKTDGKVRMLADGDAAFAKATGLTLDLNGKGLGLRSNRYSMLVKDGKVVALNVEAPGKFEVSDAATLLGQAKG

SEQ ID NO: 9127 - protein, 168 aa, Polaromonas naphthalenivorans CJ2
MIKVGDTLPAATLMEFVEVEGNGCSLGPNPVDVAQASAGKTIALFAVPGAFTPTCSAKHVPGYVAKFAEFKAAGVDEIWCLSVNDAFVMGAWARDQKTEGKVRMLADGDAAFAQATGLTLDLNGKGLGLRSNRYSMLVKDGKVASLNIEGPGKFEVSDADTLLAQVAA

SEQ ID NO: 9128 - protein, 168 aa, Verminephrobacter eiseniae EF01-2
MIKVGDRLPATTLMEYHEVEGPGCSVGPNPVPVVEATAGKTIALFALPGAFTPTCSARHLPGYLQKADEFKAAGVDEIWCISVNDAFVMGAWAREQKSAGKLRLLADGDATFTKATGLTLDLSGKGLGLRSNRYSMLVRDGKVVTLNVEAPGQFEVSGADRLLAQAKG

SEQ ID NO: 9129 - protein, 169 aa, Methylibium petroleiphilum PM1
MLKVGDKLPEGALQEFIEVEGEGCSLGPNTFEIGKLTAGKTIAVFALPGAFTPTCSAQHVPGFVKHADAFKAAGVDEIWCLSVNDAFVMGAWGREQGTGGKVRMMADGSAAFTQATGLTLDLNARGMGLRSQRYSMLVVDGTVKTLNIEAPGKFEVSNAETLLAQAGAL

SEQ ID NO: 9130 - protein, 192 aa, Delftia acidovorans SPH-1
MWVVFSFGDHHFGGPRFCTTKEIEMIKVGDALPAATLMEYVEVEGNGCSIGPNPVKLPEAAAGKTIAVFAVPGAFTPTCSAKHVPGFVEQAEAFKAAGVDEIWCLSVNDAFVMGAWARDQKTDGKVRMLADGDAAFAKATGLTLDLNGKGLGLRSNRYSMLVKDGKVATLNVEGPGKFEVSDAATLLGQAKA

SEQ ID NO: 9131 - protein, 168 aa, Leptothrix cholodnii SP 6
MLKVGDKLPAGTLNEYIEVEGNGCSLGPNSFDVTKETAGKTVAIFALPGAFTPTCSAQHVPGYVQAADALKAAGVDEIWCLSVNDAFVMGAWGRDQGTAGKVRMMADGSGTFTQATGLTLDLVARGMGLRSQRYSMLVVDGVVKTLNVEAPGKFEVSDAQTMLRQAAA

SEQ ID NO: 9132 - protein, 168 aa, Diaphorobacter TPSY uid29975
MIQVGDTLPAITLMEYSEVEGNGCSLGPNPVDVQKAAAGKTIALFAVPGAFTPTCSAKHVPGYVEQAGDLKAAGVDEIWCLSVNDAFVMGAWARDQKTDGKVRMLADGDAAFAKATGLTLDLNGKGLGLRSNRYSMLVKDGKVVALNVEAPGKFEVSDAATLLGQAKG

SEQ ID NO: 9133 - protein, 168 aa, Variovorax paradoxus S110
MIKVGDTLPSATLQEYSEVEGEGCSIGPNPVDVSKATAGKTIALFALPGAFTPTCSAKHVPGYVQHYDDFKAAGVDEIWCVSVNDAFVMGAWARDQKTGAKVRMLADGSADFAKATGLTLDLTGRGMGLRSNRYSMLVKDGKVATLNVEAPGKFEVSNAETLLAQARG

SEQ ID NO: 9134 - protein, 216 aa, Chromohalobacter salexigens DSM 3043
MTDRLLGVLTGDVVGSRRITDRQRLDEALDTTLALLERHFGAHVDRYRGDGFQVALRAPGEAMTAAVLARAALLRYSPSRRDVWDARIAVGIGYGHLPEAPHIASADGDAFVRSGQALDRLSESDERLALVLPQPDDDLALLTRFADVILQGWTHNAAEVVYWQLRHPETQQALATRLGRAQSTIHQRLSAARWPLIQDYLAHVGERLNALMETMR

SEQ ID NO: 9135 - protein, 210 aa, Pseudoalteromonas atlantica T6c
MIAVLTGDLVDSTAMPAKDYQCAVSIMDDYLAKCQTRFAAKGEIYRGDSLQLIFKQPQHAMRAAIELKSLLFSTDATQRPLGITLSVGLGEQLIDGNKPSVSQGSAFTLSGRGLDSTPSGHISLHHEGGAFFDALVLATQFLDNVLYSHTQKQARVLFHYLSMDFPTHTQLANALSTSQQNVTKHLARISADLIKAYVVFFEEKLSKESD

SEQ ID NO: 9136 - protein, 226 aa, Cytophaga hutchinsonii ATCC 33406
MKGSVITADLVNSSGMSFDQKDRLLESIRQRLLQLQSSGILASSQLYRGDSFQCLLRNPVNGLRAALILKTYIKSLDPATLRSSPVKHSASGLIFIDKMFDVRVSIGMGEVINNITDPGLSDGEAFQLSGRKLDEMKKQKLTFAISTDDIYKEELITLSALLDFIISKTTALQCEVITFKLAGLTEVDIAERLAVHQSAVNQRAAAAGWSAIENAVKRFETIYSNG

SEQ ID NO: 9137 - protein, 216 aa, Shewanella frigidimarina NCIMB 400
MEPTNKPIAVIVGDVVDSTKLTSAQFELLLKQIKSIQSWISEGHSENAHSIERGDEFQSVVHDIENALRYTVIYRIGIKALGKAFDSRISFAIAANADLRESVSESMGQAFVLSGRGLSGLKNDRLLFSSDSIALTEYFDLLFKYLDKQLNDLTARQCEVMLPMLRTNEDLSISELADMLDVATATVSKSLKASGWPLIHELNCRFIKKVAGLKYV

SEQ ID NO: 9138 - protein, 204 aa, Flavobacterium johnsoniae UW101
MTSVITGDIIDSRKNESQHWVEDLKKILSPIGKTPVQWEVYRGDEFQIEIENPEDAFLTAVLIKAHLRAIKSDARMSIGFGNKTHCAAKISESNGTAFINSGELFETLKKQKVTLAMRTGDTVFDEKLNLMIQLALTFMDSWLVQSAEFVAKAIENPTLSQEELGQILGINQAAVSRRQKRAQFDLVMNLDRYFKTQIKQLTAS

SEQ ID NO: 9139 - protein, 213 aa, Serratia proteamaculans 568
MRNSTITPRFRADKYMPAQVSVITGDLVNSRQLDTTHYLSGLNALLSQLQQAKLIQQFEIFRGDAFQAVAEPQSGLLLAVYIRIALKAMDAQRWDARIAVGLGTEQAQSAGYGSAFVNSGQALDGLMKNCRLALKNDNDQTNTIVSDLLPMLDHVVSHLSQTEARIVQARMFATSNQEVAEKLQKAASTVSATLKRAAYEEIMRFIHAINRIT

SEQ ID NO: 9140 - protein, 232 aa, Caulobacter K31
MSQANSSNAPKGAVAVLTGDIVRSQRLGSGGMALVHATFHEAVASLNRRWPGLVMGEAQFFRGDAWQLALSRPEMFLRVALFIRARLLSVGASMDTRIAVGLGGVEIFDDEAVSRSVGEAFTLSGHSLDEMGSRVDMWVNVPEAVRGSFFWLPPLLSLCSTLVGRWKPKQAYNVSLALLATNKKQEALAKDARVKRQTLGISLTSAGWPALEDVLTMIEDLDFDGLLRGPAA

SEQ ID NO: 9141 - protein, 252 aa, Alteromonas macleodii  Deep ecotype
MVQSGKHTKSGSSDTRQDAAKRLNDVQLNDKSDHKAGVLTGDISQSQSFSDDDFTSILATLKALLSKYADQYSGDFDVYRGDAFQLVVKQPEHIMLIAIGLRLALKALNPSVDVRISAAVGDAQFRAKEVKTGTGEAFVLSGRGLDDIKPYHLAFHTSHQALENSTQLITRFADAHLTGLTPTQSQTLLAYIEASDKSHENVAAILNKNRSNVSRILNASNYKLVAEYLSYMEQEINVWKLGHRPLSNAPVK

SEQ ID NO: 9142 - protein, 210 aa, Pedobacter heparinus DSM 2366
MNAQAVITGDIINFTRLNAANRKKLIEDTELLLKRWIKEKQNAEIFRGDSYQVLFDDIFEALTKSIQLICWFKKHSDEKNKIYLSTRISIGIGAVSYRGKNVLNSDGEAFHLSGRNFDTMKEGEFLTIHTNNERKNAGIKIILSFINKYIANWTMAQSEVIFLLLEGKTQQEIAEYLSLSQPSVNSRLKSAGWKEFEPTMRYIAELVKQE

SEQ ID NO: 9143 - protein, 210 aa, Dyadobacter fermentans DSM 18053
MKTFQAVITADMVNYTQFSREETTLWLEEMLAILHQNQTFKWTLAPEIYRGDSFQAVLKNPEEAMRVAILARASMRKQAPAADLRIAIGIGKTEQLTDRPGTSDGEAFRLSGHLADTMRRQKARIGIALPRPSEPLSATLDLLETVIDSWTVAQSQVIEALLQGKNVTQIADMLSISQPAASQRIAASRWWAIESFLATFPQQLSLYTKR

SEQ ID NO: 9144 - protein, 282 aa, Candidatus Methanosphaerula palustris E1 9c
MGTEIVAVLTGDLVKSQTYLTEALTSTLADLRSGFKTFKEIMGEAHNQSNFDLMISRGDSFQGLLLQPEIALKAAIYIRADLIRDSKAKFRRDARIAIGIGTVEDMDASLGEAFIKSGVWLDELKDMKQNLIIRTSFGDEINREFDTECALTDGIIQKWTSGQAEAVKEYVISENQEEVAKKLGISQAAVSLRLNGSNYSLLQKFFSRYQEIISREIQKQTEITTNNRSENLDLAAKRIAEVMWNLGYRHLSDAELNSLSKNDALSRKVEARLKQYQGSAQK

SEQ ID NO: 9145 - protein, 187 aa, Shewanella sp. MR-7
MYSKHAGIQAASSSQIKAAHQPHVAGALRQFADSEELSEVANAANISKPQMLRNKLLLNQPHQLSIHEAVDIAKVSGNRCIIDGMLLELGCVPSVPVAELANSERLSLTDRALEITANSARLGAIALDIKARRRVNERMRHEVVKRASLVMSELAIFVHDVEQKFQAVPVLSVAFDAMQTMPMPGVM

SEQ ID NO: 9146 - protein, 188 aa, Shewanella baltica OS155
MYSNSSGTQAGTLPPAKAAHQPHIAGALRQFADGEQLNEIAIAAKFNRPQMLRNKLLLNQPHQLSIHEAVDIAKASGNRCIIDGMLLELGCAPSIAIDDLNQCERMSLTDRALEISANAGWLGNMALDVKARRGGVTERMRHEAVKRASRAMSELALFMHDVEQKFQAIPVLSVAFDAVQNLPMPGAM

SEQ ID NO: 9147 - protein, 169 aa, Enterobacter sp. 638
MFDYRISKHPHFNEACRAFALRHNMAKLAERAGMNVQTLRNKLNPEQPHQLTAPDIWLLIDLTEDSTLVDGFLAQIHCLPCVPTNEVAREKMPQYVLKATAEIGRVAASAVSGVQMNATTRRQVVESVNSVTRLMALTAISLQARLQANPAMASVVDTVTGIGSSFGLS

SEQ ID NO: 9148 - protein, 179 aa, Vibrio cholerae O395
MVSDIAMYELRERKQQAYNAVCSDFVVNHNIEQLAKRISLDGQSLRNMLNPAQPHKLSPVDLVLLCKASGDYTIINTLFSDCGVVAVALPEQGEEKNIIERVLLNTSLCGELSSDAMQMCTAERLPRSRKRKTLAKCQAALGNLALLIADLEKRTTGLQPLIQMGSDFMAQGAPIPGFA

SEQ ID NO: 9149 - protein, 169 aa, Escherichia coli HS
MFDYQVSKHPHFDEACRAFALRHNLVQLAERAGMNVQILRNKLNPAQPHLLTAPEIWLLTDLTEDSTLVDGFLAQIHCLPCVPINEVAKEKLPHYVMSATAEIGRVAAGAVSGDVKTCAGRRDAISSINSVTRLMALAAVSLQARLQANPAMASAVDTVTGLGASFGLL

SEQ ID NO: 9150 - protein, 169 aa, Escherichia coli C ATCC 8739
MFDYQVSKHPHFDEACRAFALRHNLVQLAERAGMNVQILRNKLNPAQPHLLTAPEIWLLTDLTEDSTLVDGFLAQIHCLPCVPINEVAKEKLPHYVMSATAEIGRVAAGAVSGDVKTSAGRRDAISSINSVTRLMALAAVSLQARLQANPAMASAVDTVTGLGASFGLL

SEQ ID NO: 9151 - protein, 177 aa, Yersinia pseudotuberculosis YPIII
MVTLGGLTMFDYQVSKHPCFDVAMRGFALAHNLSELAGRVGMNAQTLRNKLNPEQPHQLTVTELLAITDATEDANLIDAMLAQINCMPSVPVNEASADNISTYALKATAAVGSIAAAAVQGNHKTAFSKSALLDSVNTAIRHLSLIGLTVQCRIQSTPALASTVDVISGLSAAAGLS

SEQ ID NO: 9152 - protein, 112 aa, Methanosarcina barkeri fusaro; identical to SEQ ID NO: 4935

SEQ ID NO: 9153 - protein, 162 aa, Burkholderia pseudomallei 1710b
MKRRPPEVKREARDDAARGDARHAGAGAAPDDPRGAARRDPPPGSRAARGGATHPAARAAEPAAPKPAADRVERAAHTAAARAARGARDPEPSLGRRLAQIGVLGWTIVAPTLAALALGRWLDRMFATRVFFSAPLLMLGAALGLWLAWRWMKAQQHGDRDD

SEQ ID NO: 9154 - protein, 122 aa, Pelobacter carbinolicus; identical to SEQ ID NO: 4936

SEQ ID NO: 9155 - protein, 106 aa, Chlorobium luteolum DSM 273; identical to SEQ ID NO: 4937

SEQ ID NO: 9156 - protein, 163 aa, Nitrosospira multiformis ATCC 25196; identical to SEQ ID NO: 4938

SEQ ID NO: 9157 - protein, 162 aa, Burkholderia thailandensis E264
MTKRRPFEAKRDDAARGDARRAGASAARDDARDGAPREPSPESSGSPAARDGGRPPAVRPADAAPKPAADRVAQAARTAATRAARGARDPEPSLGRRLAQIGVLGWTIVAPTLAALAIGRWLDRVFASRVFFSAPLVMLGAALGFWLAWRWMKGQQEGDRDD

SEQ ID NO: 9158 - protein, 111 aa, Rhodoferax ferrireducens T118; identical to SEQ ID NO: 4939

SEQ ID NO: 9159 - protein, 105 aa, Burkholderia xenovorans LB400
MSTPQRDERSSREDKLAGAAQQAAERAARGRAEPEPSLGTRLGQIGILGWAIVVPTLLGLALGHWLDRTFGTRVFFSAPLLMVGAALGFWSAWKWMHRQQGAHRE

SEQ ID NO: 9160 - protein, 103 aa, Burkholderia xenovorans LB400
MSRSDEPDDNERLAHAARQARTRERRARDEPEPSLGNRLGQIGILGWSIVIPTLLGLAIGHWLDRHFGTGVFFSAPLLMIGAAFGLWSAWKWMHRQTRSKHHD

SEQ ID NO: 9161 - protein, 130 aa, Pseudoalteromonas atlantica T6c; identical to SEQ ID NO: 4940

SEQ ID NO: 9162 - protein, 121 aa, Rhodobacter sphaeroides 2 4 1
MTGPGPGSAPPGAGPGPDPAAAPAISPPAPPGASPDPLAEAVRRSAVRAEAGRRDPEPSLARRFGQIGVLGWVIVLPTLGGVLAGGWLDRLLGTGITFAAALTMAGAALGLWLALRWMHAQ

SEQ ID NO: 9163 - protein, 125 aa, Shewanella frigidimarina NCIMB 400; identical to SEQ ID NO: 4941

SEQ ID NO: 9164 - protein, 127 aa, Psychromonas ingrahamii 37; identical to SEQ ID NO: 4942

SEQ ID NO: 9165 - protein, 111 aa, Polaromonas naphthalenivorans CJ2; identical to SEQ ID NO: 4943

SEQ ID NO: 9166 - protein, 121 aa, Rhodobacter sphaeroides ATCC 17029
MTGPGPGSAPPGAGPGPDPPAPPAISPPAPPGASPDPLAEAVRRSAVRAEAGRRDPEPSLARRFGQIGVLGWVIVLPTLGGVLAGGWLDRLLGTGITFAAALTMAGAALGLWLALRWMHAQ

SEQ ID NO: 9167 - protein, 163 aa, Burkholderia mallei NCTC 10247
MMKRRPPEVKREARDDAARGDARHAGAGAAPDDPRGAARRDPSPGSRAARGGATHPAARAAEPAAPKPAADRVERAAHTAAARAARGARDPEPSLGRRLAQIGVLGWTIVAPTLAALALGRWLDRMFATRVFFSAPLLMLGAALGLWLAWRWMKAQQHGDRDD

SEQ ID NO: 9168 - protein, 166 aa, Burkholderia pseudomallei 668
MMKRRPPEVKREAREARDDAARGDARHAGAGAAPDDPRGAARRDPPPGSRAARGGATHPAARAAEPAAPKPAADRVERAAHTAAARAARGARDPEPSLGRRLAQIGVLGWTIVAPTLAALALGRWLDRMFATRVFFSAPLLMLGAALGLWLAWRWMKAQQHGDRDD

SEQ ID NO: 9169 - protein, 166 aa, Burkholderia pseudomallei 1106a; identical to SEQ ID NO: 9168

SEQ ID NO: 9170 - protein, 134 aa, Bradyrhizobium BTAi1
MTQPENHERLGQAVRRRQERRERWQREGERSLGQNFAMIGALGWTIVVPTLLGIFAGRWLDRTFHSGIFWTWACSWQVWQRAAHLHGRGCTAHDPHEFDHSSRTHAVDGICGSDVWAGVFCGSQAQRDAACPQR

SEQ ID NO: 9171 - protein, 126 aa, Marinomonas MWYL1; identical to SEQ ID NO: 4944

SEQ ID NO: 9172 - protein, 95 aa, Dinoroseobacter shibae DFL 12
MTQKPDRSAEDIGQRARRMKAARDDPGPSPLRGIGTFGMIGWSIAVPTVGGVFLGLWLDRVAPQTFSWTIALLLGGVVLGALIAWNWIGKEGDGR

SEQ ID NO: 9173 - protein, 84 aa, Beijerinckia indica ATCC 9039
MAQAAREAAERARKGAENPEPSLGARLGQIGILGWTIVVPTLLALLLGRWLDQIFATGIFFSAPLIMIGAGIGFWSAWKWMHRP

SEQ ID NO: 9174 - protein, 104 aa, Burkholderia phymatum STM815
MTRQRNGHVTPDDRVANAARRAANRDAMGREDREPSLAARLGQIGILGWTIVLPTLAGLALGRWLDRLMGTRVFFSAPLLMLGAAIGFWSAWKWMHRQQRRDRD

SEQ ID NO: 9175 - protein, 105 aa, Burkholderia phytofirmans PsJN
MNSQLPDRRKSGDDRMAGAARHAAARDAHGRADPEPSLGSRLGQIGILGWAIVLPTLLGLAIGHWLDRAFGTRVFFSAPLLMIGAAVGFWSAWKWMHRQQRGHHD

SEQ ID NO: 9176 - protein, 105 aa, Rhodopseudomonas palustris TIE 1
MTAPKQTPQPEPTAVPDEQDSLVKGVRLRGGRHQRWLREGDPSVARMLAQIGVLGWIIVVPLLIAVFGGQWLDQKFNSGIFCTAPLLIVGLALGCWSAWKWIERQ

SEQ ID NO: 9177 - protein, 111 aa, Prosthecochloris aestuarii DSM 271; identical to SEQ ID NO: 4945

SEQ ID NO: 9178 - protein, 95 aa, Azotobacter vinelandii DJ
MNPQRDEGREPLGEAARRAVRREEQARRDPEPSLGRRLGQIGVLGWAIVVPVLLGLLLGRWLDRLFGTGVTFAAALLFLGACLGLWSAWRWMHRQ

SEQ ID NO: 9179 - protein, 110 aa, Desulfomicrobium baculatum DSM 4028; identical to SEQ ID NO: 4946

SEQ ID NO: 9180 - protein, 288 aa, Flavobacterium johnsoniae UW101
MIMKILQKYRAVAMISVSMLFAACAQEDQPKETQLDYTVRNKTELDTWIETSFLNPYNIKVYYEWNQNLVDNNRFLFPPTVDRVKPAMEVVKAIWIDSYSTIGGADFVKKISPREFVLVGGTNLNTSGTVTLGIAEGGQRVTLFELDYLNRKSRADVTRFIHTIQHEYVHILNQTKPFDEQAWAKLTPAGYTSSWYIYTDAASRALGFITNYARLNIYEDFAETASIILTSSKAEYDAILASVTDATAKANLKKKEAIVVQYYKDNFGMDFYALRDEAQKNTTTVINN

SEQ ID NO: 9181 - protein, 279 aa, Capnocytophaga ochracea DSM 7271
MKKIYFIAMFTLLLVACNRKETLSDKSVLKTKVTAQTELDTYIYNNFQKPYNIIVTYNWKDSDFEFNKFLYPPTESKIKPMLEVVKKVWIDSYSEIAGANFIKEVAPRQISLVGGYNVNENGTITLGFADSGMKITLFNVDQLDLTNHAGTRLYFHTIQHEYCHIINQKKPYSTEFGKITPNYTSVWANYGNDEANELGFITNYARANDVEDFAEMTSTMLGMSKTAWDAKVEAITDTKAKEAIRKKEEFVVAYFKSEWNIDFYALQAKVEEQMLSVLQ

SEQ ID NO: 9182 - protein, 465 aa, Pedobacter heparinus DSM 2366
MKNFIYTLGIFSLLGLTISCKKSENLDKEIVGLGGDTWVQGALDQWLYTNFTQPFNMSVKYRWDGTEYDPAKTLTPPKVERVQPLMEMVKAVWIDPYVSESNMDFIRKYGPKNYVLVGSLQYNVGGTVTLGEAEGGVKVTLFNVNNFSKTNREVSQRVLKTIHHEFTHILNQTISYQKEFPQVTPAGYTADWNNTTLVNANNAGYITQYSQASPNEDFAEMTSVMLTEGKSSYDAIVNSIVVPKLDSIPDPANPPFIIVRELPNTAAQAALRKKEQFVVSYFKSSYGIEFARLQNKVNYALAANAPSDLATLFGNRKKYTSISVDPDNVPGMSANFMSTWATTKTGLAAVGGQGRVLNNFVLFFYPRAGELVLRINYANSTGVLAANFVYKVAYNANNQLTLTYLRRDGNAEVIAPGVVALTNYLTSGSFAVSWRYDANFLEFGQWTKVSDPTSSFFGNLGVIKY

SEQ ID NO: 9183 - protein, 309 aa, Dyadobacter fermentans DSM 18053
MKTIFRHFTHYMIAALLLGMTSCKEEELGNVDDIPGLGGDVWAEGPIDKWIQDSLVVPYNISAKYKWDQFEFGNMTKNLVPPDEAQVVPLLSTIKKAWTTPYVEEAGKVFYNKYSPKFFILSGSNEYNVESGSITLGTAEGGRKVILYGVNLFKIKGMAGYDPGRDSSFVKDWFLHTIHHEFGHILHQTVFYPVEYKNISKAYYQGGNWINWSDADARRDGFITAYSSSSFDEDFVEMIAMMLTEGRAGFDKIVNSIPEGTSRSGVTKAQAQAALRQKEAIIVAYYKNTWKIDFYSLQNKVRTSMNKLF

SEQ ID NO: 9184 - protein, 303 aa, Chitinophaga pinensis DSM 2588
MKNIKTLFLLLTLALLAACAKDDDLSNLEDIPGLGGDTWQKTALDKWLYDTLVVPYNIEAKYKWDQFEFDLNKTLVPPQEAMVKPALQSIKKVWIDTYVQEAGIEFFRQNSPKFLILCGSASWNVDNGTITLGTAEGGRKVVLYSINSFRIKGMPNYKPSDSATLKQIFHVIEHEFGHILHQTILYPPAFKNISAGRYSANWTNISDDEAHANGFITPYAMSGFDDDFVEMISLMLTDGRAGFERLIASIPEGTAASGVTQAQAISALRQKEAMVVAYFKTAWKIDFYSLQTKKRKAVESLIY

SEQ ID NO: 9185 - protein, 295 aa, Chitinophaga pinensis DSM 2588
MILTVAAFAACAKKEDDLSGVQDIPGLGGDTWVPGSLDAWLHDTMTVPYNIEVKYKWDQFEFDVTKTLVPPREEVVIPAIRAIKKVWIDNYIREAGAIFFKKYCPKFFILSGSASWNDNGTITLGTAEGGRKVVMYLLNDFRTKEMPGYKKSDTGNVKQIFHVIEHEFGHILHQTVMYPVEFKKICAGYYTGNWNNIADSEARKDGFVTAYAMSNENEDFVEMIAMMLIEGKAGFDRIVNSIPEGTSVNGSSQAQAKDRLRQKEAMVVSYFKTAHKVDFYSLQDNTRKSIVQLLY

SEQ ID NO: 9186 - protein, 282 aa, Chitinophaga pinensis DSM 2588
MKQMQIKLLMVFIFLGSIMACSKDDKIDSVNIPGLGGETWVKGPLDFWLDSVFTKPFNIEVKYRFERYELTLDKTLVPVMESKVQPVMSTIQKTWIAPYIAEAGETFFKTYCQKQFVLVGSPQFNSNNTITLGTAEGGRKIVLFWLNDFLLTDKPFVKEMLHTIHHEFAHILHQTIMYPVEYKRISTGYTGSWNDYTLEEALDRGFITQYARSAPDEDFVEMISTMLVEGKDGYEAIIAEAPDDAQAKFRQKEEIVVRYFMENYNIDFYRLQTRVQDAIDNL

SEQ ID NO: 9187 - protein, 216 aa, Dehalococcoides ethenogenes 195
MRIFLDTANIEEIKKGLKLGVVSGVTTNPTLVAKEGISDYKSVVQQICALLPEGDVSAEITAEDPAEMLKQAREIAKWAPNVVVKIPATAEGLEIISKLSKEGVRFNMTLCFSVNQALLGALAGAAFVSPFVGRLDDAGHDGMMLINDIVSIYKEYGFETQVIAASIRHPLHCTQAAQTGAGIATVPYKVLMQMMQHPLTDSGIARFMADWKSVQK

SEQ ID NO: 9188 - protein, 246 aa, Deinococcus geothermalis DSM 11300
MQFFIDTAIIDEVREINRWGVLSGVTTNPSLVAASGRDFKEVIQELAALVGGAISAEATALDAEGMIKEGREFASWSEHVVVKLPLTPAGLQACQALTSEGIRTNITLCFSVPQALLAARAGASYISPFAGRVDDIGWDGIELVRQIKEAYVLGDIPTKVLAASIRHPQHVVQAALAGADVATVPYKVFTQMIKHPLTQAGLDAFLQDWARRAGASPETPSSEAGSNPQQGGVTAQGEPVQGGQRQ

SEQ ID NO: 9189 - protein, 215 aa, Moorella thermoacetica ATCC 39073
MRIFIDTANVEEIKAANDLGIIAGVTTNPSLIAREGRNFREIVEEIAAIVDGPISAEVVSTTAPEMVAEGVELAAIHPNIVIKIPMIAEGLKAVKELSARGIKTNVTLVFSANQALLAALAGATYVSPFVGRLDDISHDGLQVIADIVPIFAQYGFKTQIIAASIRHPLHVLEAARLGADIATVPFKVLMQMLKHPLTDTGLARFLADWEKVKNK

SEQ ID NO: 9190 - protein, 216 aa, Desulfotomaculum reducens MI-1
MLLFIDTANVDEIRAANALGVIAGVTTNPSLIAREGRDFAEVVKEITSIVDGPISAEVISLDAEGMMKEAVELAAIHPNIVIKIPMTTEGLKATRACMEKGIKTNVTLIFSANQALLAARAGATYVSPFVGRLDDIGQDGIGLIYDIADIFNNYDLATQIISASIRHPLHVQQSAKAGAHIATVPYKVLLQMAKHPLTDKGIDAFLADWAKLTPKA

SEQ ID NO: 9191 - protein, 216 aa, Dehalococcoides BAV1
MRIFLDTANIEEIKKGLKLGVVSGVTTNPTLVAKEGISDYKSVVQQICALLPEGDVSAEITAEDPAEMLKQAREIAKWAPNVVVKIPATTEGLEIISKLSKEGVRFNMTLCFSVNQALLGALAGAAFVSPFVGRLDDAGHDGMMLINDIVNIYKEYGFETRVIAASIRHPLHCTQAAQTGASIATVPYKVLMQMMNHPLTDSGVARFMADWKSVQK

SEQ ID NO: 9192 - protein, 215 aa, Candidatus Desulforudis audaxviator MP104C
MELFLDTANVDEIREAAALGVISGVTTNPSLIAREGRDFTQVVREITGLVDGPVSAEVISTEAEAMVAEAEELSQIHPNVVIKIPMILEGLKAVSMLEPRGIRTNVTLVFSANQALLAALAGASFVSPFVGRLDDAGHDGMEVVRDTVDIFDLYELPTRVIAASIRHPLHVLAAAKAGAHIATVPYQVLMQMAGHPLTDVGLRKFLDDWARLKKR

SEQ ID NO: 9193 - protein, 220 aa, Eggerthella lenta DSM 2243
MKFFLDTADLDEIEEAASWGVLAGVTTNPTLYARTGGKLDDFHNHIKRICEIVDGPVSAESVAMTRDEIIRDGRELAALADNVVVKIPTMVEGLAATKALSEEGIPVNMTLCFSVPQAIMAARAGARYISPFVGRFDDIAEDGISQLADVVAAVNNYDFGHDVEIIAASVRSANHVTQAALMGADIATVPFAALKKCVQHPLTDRGLDAFMKDWEKVQQA

SEQ ID NO: 9194 - protein, 226 aa, Cryptobacterium curtum DSM 15641
MKFFLDTADLAEIEEAASWGAIAGVTTNPTLYARTGGKLSDFHNHIKRICEIVDGPVSAESVAMQRDEIVRDGLELADIADNVVVKVPTMVEGLAATHELARRGVPVNMTLCFSVPQALLAARAGARYVSPFIGRFDDISEDGLDQVSNIVGALSQYDFSDATVHGERIEVIAASVRSAHHVTQCALMGADIATVPFGVLKKMVQHPLTDRGLESFMKDWEKVQGA

SEQ ID NO: 9195 - protein, 226 aa, Slackia heliotrinireducens DSM 20476
MKFFLDTADLDEIKEAASWGALAGVTTNPTLYSRIGGKLDDFYNHIERICDIVDGPVSAESVAMTRDEIVRDGRELARIAPNVVVKVPTMVEGLAACRTLADEGIRVNMTLCFTVPQAILAARAGARYISPFVGRFDDISENGLAQLEDVVTAINNYDYTENTVNGEQIEIIAASIRSANHVTQAALMGADIATVPFNVLKKMIQHPLTDRGLESFLKDWEKVKNA

SEQ ID NO: 9196 - protein, 219 aa, Desulfotomaculum acetoxidans DSM 771
MVLEIKLFLDTANVEEIRDAYSLGVISGVTTNPSLIALEGRDFVQVVREIASIVDGPISAEAVSLEAAPMIEEARQLSSIHPNIVVKIPMTAEGLKAVKELSSQGIKTNVTLIFSANQALLAALAGASYVSPFVGRLDDIGYNGMQLIEEIMAIFNQYGLIAEVIAASVRHPMHVIDAAKSGADIATIPYKVLYQMIKHPLTDSGIERFLKDWEKVPVK

SEQ ID NO: 9197 - protein, 215 aa, Alicyclobacillus acidocaldarius DSM 446
MKLFIDTANVDEIRRAADMGILSGVTTNPSLVAKEGRDFVQVLKEIVEIVDGPISAEVVSLDAEGMVKEALPLSEIHPNIVIKIPMTAEGLKAVHQLAKRGIRTNVTLIFSANQALLAARAGASFVSPFIGRLDDISMDGVELIADIAQIFDIHGIETEIIAASIRHPMHVTAAAKAGAHIATCPFSVLDQMIKHPLTDRGIERFLADWNKMSQK

SEQ ID NO: 9198 - protein, 257 aa, Ralstonia solanacearum
MSTPEEIVRLDRKLILRDATRELSMPSRRLFGKRAITLGGLLLLTGCRITDEPSVESFLMTVSRFNDRVQAWLFDPRRLAPTYPESELTRPFPFNAYYGIDEVPEVDANGFQLEVGGLVSRKTPWTLDALYALPQTSQVTRHICVEGWSAVGKWGGTRFSDFLQRVGADMTAKYVGFRCADDYYSSIDMPTALHPQTLLTFTYDGERLPPKYGFPMKLRMPTKLGYKNPKHIVAIFVTNKYPGGYWEDQGYNWFGGS

SEQ ID NO: 9199 - protein, 262 aa, Dechloromonas aromatica RCB
MIKKPSRQLSIDGDLVLKDAMKDIARHLDQPTRRAFLQRSLSLGGLSLLSGCAMVDESGVENALMTVSRFNDRVQAWLFDPKRLAPTYPDSMITRPFPFNAYYGEDEIREVEEESYRLEVTGMVADKHAWTLAELRAMPQTDQITRHICVEGWSAIGKWGGVPFASFLRKVGADLSAKYVGFKCADDYYTSIDMPTALHPQTLLTLTYDSQPLPPRYGFPMKLRMPTKLGYKNPKHIQAIFVTNTYPGGYWEDQGYNWFGGS

SEQ ID NO: 9200 - protein, 263 aa, Polaromonas JS666
MIKTPPRLAIDGDAVLKEAVSRISHASRIKEPARRDFLRRSLTLGGLSMLTGCTLVDEASIDTALMRISRMNDKVQGWLFDPNRLAPTYPDSMITRPFPFNAYYSESEVRQIEESSYRLEVTGLVADKRKWALAELRAMPQVDQVTRHICVEGWSAIGKWGGVPFASFLRRVGADLTAKYVGFKCADDYFTSIDMPTALHPQTVLALTYDGQPLPPKYGFPMKLRMPTKLGYKNPKHIQAIFVTNTYPGGYWEDQGYNWFGGS

SEQ ID NO: 9201 - protein, 263 aa, Polaromonas JS666
MIKTPPRLAIDGDAVLKEAVSRISHASRISEPARRDFLRRSLTLGGLSMLTGCTLVDEASIDTALMRISRMNDKVQGWLFDPNRLAPTYPDSMITRPFPFNAYYNESEVRQIEESSYRLEVTGLVADKRKWALPELRAMPQVDQVTRHICVEGWSAIGKWGGVPFASFLRRVGADLTAKYVGFKCADDYFTSIDMPTALHPQTVLALTYDGQPLPPKYGFPMKLRMPTKLGYKNPKHIQAIFVTNTYPGGYWEDQGYNWFGGS

SEQ ID NO: 9202 - protein, 262 aa, Serratia proteamaculans 568
MKAQKQPISLSEGQEIVREAQQLLARQLESSSRRRFLRNGLTLGGIAMLTGCDISDNTNVEQALSRISRFNDRVQGWLFNADHLAPVYAESMITRPFPFNAFYAEDQAPEINGDDYRLEVNGLVLNKQPWTLPQLHKMTQISQVTRHICVEGWSAIGKWGGVPFAEFLQAIGADLSAKYVSFKCADDYYTSIDMATALHPQTIMALTYDGQILPRKYGYPMKLRMPTKLGYKNPKHIQVIEVTNRFPGGYWEDQGYNWFGGS

SEQ ID NO: 9203 - protein, 263 aa, Delftia acidovorans SPH-1
MKIFKVPSLPGVDGEAVVREARSLIVRKLDQPARRAFLQRSLTLGGLSLLTGCSISDDSHVEAALSQVSRFNDRMQGLLFSPTRLAPTYSAAEITRPFPFNAYYGEDEVREVDGASWRLEVTGMVADRHAWTLAELRAMPQDEQITRHICVEGWSAIGRWGGVRFADFLRHIGADTSAKYVGFKCVDDYFTSIDMATALHPQTLMALTYDGQPLPPKYGFPMKLRMPTKLGYKNPKHIQAMFVTNTYSGGYWEDQGYNWFGGS

SEQ ID NO: 9204 - protein, 258 aa, Burkholderia phymatum STM815
MKTSDKPIVKLDREAILADARRELEMPSRRLFGKRMLTLGGLSLLTGCSITDEDSVNKFLTAVSRLNDRAQALLFDPKQLAPTYTEAQITRPFPFNAFYGIDDVPEVDGSDYRLKVSGLVTGQRVWTLPELYALPHAEQITRHICVEGWSAIGRWGGTPFAGFLRRIGADTTAKYVGFRCADDYYESIDMPTALHPQTLLTFEYDGERLPAKYGYPMKLRMPTKLGYKNPKHIVEIFVTNTYPGGYWVDQGYNWFGGS

SEQ ID NO: 9205 - protein, 249 aa, Gluconacetobacter diazotrophicus PAl 5 JGI
MSHNRLDRSAIAPELRRIERRLMLKGALSLGGLSMLSGCALDDEPSVERALSAMSRFTDRMQALLFSRQRLAREFDASRITHPFPFNAYYDESEVRTVDPAGWRLDVGGLVSDRRPWSLAQFRALPQKRQITRHICVEGWSAIGDWSGVPLSMFLQKVGADLRAKYVNFRCFDDYSTSIDMATALHPQTILALDYGDRALPPAYGAPMKVRIPTKLGYKNPKYLASIEVTNRFPGGYWEDQGYDWFGGS

SEQ ID NO: 9206 - protein, 249 aa, Gluconacetobacter diazotrophicus PAl 5 JGI
MKRPDLDRAAIAPELRRLECRLMLKGMVSLGGLAMLSGCVLDDEPAVERALARVMNFTDRAQALLFSRHRLAREFDASRITRPFPFNAYYGQDEVRTVDPAQWRLEVSGLVTDTRPWSLARFRALPQKRQITRHICVEGWSAIGCWSGVPLSVFLQHVGADLRAKYVDFHCFDDYSTSIDMATALHPQTIMVLDFDDAALPAAYGAPMKVRIPTKLGYKNPKYLAAITVTNRFPGGYWEDQGYDWFGGS

SEQ ID NO: 9207 - protein, 263 aa, Variovorax paradoxus S110
MRIFKAPKMTGVDADAVVREARTLIAKQLDQPARRAFLQRSLTLGGLSLLTGCSISDDSHVEAALSKISRFNDKVQGLIFSPTQLAETYPESMITRPFPFNAYYGEDEVREVDEAGYRLEVTGMVADRRSWTLAELRAMPQHDQVTRHICVEGWSAIGKWGGVRFADFLRRIGADTTARYVGFKCADDYYTSIDMPTALHPQTLLTLSYDGQPLPPKYGFPMKLRMPTKLGYKNPKHIKAMFVTNTYSGGYWEDQGYNWFGGS

SEQ ID NO: 9208 - protein, 273 aa, Acidovorax sp. JS42
MRTNTLYQVTLLDTLAAWTLALLWLLPLAYAVWTAFHPAEYATRFDLLAPWTLENFRRAWEAAPFARYFLNTTVLVAMILAAQLVLSTLAAYAFARYRFRGQNVAFALVLVQLMVMPDILLVENYKTMGRLGLVDSLVAIGLPYFASAFAIFLLRQTFMGIPKELDEAARVEGASALQILWRVYVPLARPVYTAFALVSVSFHWNNFLWPLIITNSVESRPLTVGLQVFSSVEQGVEWSLITAATLMSTAPLLIGFILFQRQFVQSFMRAGIK

SEQ ID NO: 9209 - protein, 274 aa, Mycobacterium tuberculosis F11
MSSPSRVSNTAVYAVLTIGAVITLSPFLLGLLTSFTSAHQFATGTPLQLPRPPTLANYADIADAGFRRAAVVTALMTAVILLGQLTFSVLAAYAFARLQFRGRDALFWVYVATLMVPGTVTVVPLYLMMAQLGLRNTFWALVLPFMFGSPYAIFLLREHFRLIPDDLINAARLDGANTLDVIVHVVIPSSRPVLAALAMITVVSQWNNFMWPLVITSGHKWRVLTVATADLQSRFNDQWTLVMAATTVAIVPLIALFVTFQRHIVASIVVSGLK

SEQ ID NO: 9210 - protein, 274 aa, Opitutus terrae PB90 1
MKRPLAWIVSVATAAVFLAPLLWMLLASLRDESRIFHFDAANWFTTTGWTLQNYADALRRAGLGQALLVSLLQVGLIVAGGLVVNTTAAYAFARLSFPGRDTLFALVVMLIILPVEVLAVPMFFTARDLGLTGGFGPALAGLTVPFFAKAFNLYFLRQHFLALPVELEEAAVIDGATSWRQFRHVALPAVKPALATVVLLDVLAHWGDFLWPLLIGTREETRTVQLALANLFTTPPVQWGDILACAVLATLPVLLLFRGLQRHLVATEVRSGIK

SEQ ID NO: 9211 - protein, 274 aa, Methylobacterium sp. 4-46
MTRERLPALGRAATGLLALVWVIPFLWMGVATLRPPGAAGAAASLVPGGAPSLANLAEAWASAPFPLYALNTLLMCAGILALQLVTASLAAYAFARLDFPGRTALFYAFLVQLMLVPVVLIVPNLKTVAMLGLYDTLLGVMAPYCATAFGTFLLRQSFREVPRELEDAARIDGAGLLQRIRHVYLPLTKPTLIAFSIVSVTTHWNEFVWPLMVVTSPDRRPLTLGLATFTLSAEGTQAWGVIAAGTLLVSTPLLVAFLLFQRRFVNSFLASGLK

SEQ ID NO: 9212 - protein, 273 aa, Diaphorobacter TPSY uid29975; identical to SEQ ID NO: 9208

SEQ ID NO: 9213 - protein, 303 aa, Beutenbergia cavernae DSM 12333
MTSQHQESAPSSALSTPTAHGGRTAASASRSRAWANVLTYAFLLAAGVIVLAPFLFSVMTSLKTPRQFNTTWPLTLPDPWTIENYTALFGERYDFVVPIAVTAQVVVVLVLTQMLTSVLAAYAFAVLDFPGRDALFWVYVACLMIPAVVIIIPLYSMMTSVGLKNTFAGLVVPFLFAGPYAIFLLRENFRSVPTDILDAAKLDGAGVLRTLFRIMLPMNVPILTTLLLITVVTQWNNFMWPLVIAPKTEWNVITVATAALQTQYEGNWTLVMAASTIALLPLVILFLVFQRRITSAIGITGLR

SEQ ID NO: 9214 - protein, 302 aa, Brachybacterium faecium DSM 4810
MTLQDRTPVAAPAPGRRRPLTSSLLARRVMGHAATYLVLVAAAVLTLGPFLFSVMTALTSTQQFAQQGPLSMPAPAVLDNFVALFAPSAGADGFITPVAVTVQMVAVILVGQMVFSVLAAYAFAQLRFPGRDLLFWVYVATLMVPQVVVVVPLYLVLSEAGLRNTFWALVIPFVLGSPYAIFLLRENFRGVPSELMDAMRIDGAGTLRLLWHLVVPLNRPIIVTLVLITVVTHWNSFMWPMVITSGPEWRVITVATSALQSQYNNNWTLVMAGTTLAMLPLVILMVLFQKQITRSVGDATLR

SEQ ID NO: 9215 - protein, 244 aa, Ralstonia solanacearum
MSEAVMTANETTHRAEWGDTAVLQAQGLVKAFRQGGLNVDVLRGVDIRIGVGEKVAIVGASGSGKSTLLHVLGGLDVPTSGRVSLLGKPFTAMSERERNTLRNRALGFVYQFHHLLPEFTALDNVAMPLRIRGENEAQARHTAQAMLARVGLGERTAHRPGELSGGERQRVAIARALVGSPACVLADEPTGNLDDHTAGEVFDLMLELTRTLGTSFVIVTHDIDLAGRCDRILRLRDGHLHQER

SEQ ID NO: 9216 - protein, 244 aa, Ralstonia eutropha JMP134 [sequence omitted]

SEQ ID NO: 9217 - protein, 249 aa, Cupriavidus metallidurans CH34 uid250
MSDTTLLPEASFQAGTQGPGTPTGTPVLLGEGLTKRFKQGGLDVEVLRGVDVRVDAGEKVAIVGASGSGKSTLLHVLGGLDNPDAGRVALLGKPFTALREKQRNIVRNRSLGFVYQFHHLLPEFTALDNVAMPMRIRGLSEPAARAEAQAVLERVGLGGRSKHRPGELSGGERQRVAIARALVGKPACVLADEPTGNLDDHTAGGVYDLMLELSRTLGTSFVIVTHDLDLAGRCDRVLRLRDGHLHQER

SEQ ID NO: 9218 - protein, 227 aa, Ruegeria sp. TM1040
MSEVTLKIEGLRKTYLAGTPGEVAVLRGVDLTLHAGEVVALVAPSGAGKSTLLQIAGLLDVADAGRVEIAGQDMAGARDRKRTRVRRQDVGFVYQFHHLLPEFSALENIVLPQLANGISQRDAEARGAELLALVGLETRAAHRPAALSGGEQQRVAFCRALANRPRLLLADEPTGNLDPATSDQVFEVLMQLVSETGLSALIATHNLELAARMDRVLHLEDGVLVER

SEQ ID NO: 9219 - protein, 224 aa, Rhodobacter sphaeroides 2 4 1
MSEMLVLDGLTKAYNRGRPGEVTVLRGATLSVGTGEVVALVAPSGAGKSTLLHIAGLLDTPDEGRVAIGGTEMAGLGDRARTGTRRREVGFIYQFHHLLPEFTALENVVLPQLANGVSRRGAEARARDLLGRVGVGAREGHRPAALSGGEQQRVAFCRALANAPRLLLADEPTGNLDPGTSDQVFGVLMDLVRGTGLSALIATHNLELAARMDRVVRLEAGRVV

SEQ ID NO: 9220 - protein, 220 aa, Paracoccus denitrificans PD1222
MSDILVLEGISKTYGIGGPAPVPVLNGLSLQIVRGEVVALVAPSGAGKSTLLHIAGLLDTADSGRVLLKGRDMAGQSDRARTEARREELGFVYQFHHLLPEFSAAENIVLPQLANGVSQATARARALDLLGRVGLTHRADHRPAQLSGGEQQRVAFCRALANQPSLLLADEPTGNLDPATSDKVFDMLMALVRETGLAALIATHNMDLAARMDRVIRLDA

SEQ ID NO: 9221 - protein, 240 aa, Burkholderia mallei SAVP1
MNQNHQDGGARECVLEARGVTKTFVQGGFNVQVLDNAQVSVRRGEKLAIVGASGSGKSTLLHVLGGLDEPSAGQVSLLGKPFTQLAERERNELRNRALGFVYQFHHLLPEFTALDNVAMPLRIRRMSTEEARRHAREMLEQVGLGARAKHRPGELSGGERQRVAIARALVTKPACVLADEPTGNLDGSTADHVFHLMLELSRTLDTSFVIVTHDPDLAARCDRILRLRDGVLHEEPAVPV

SEQ ID NO: 9222 - protein, 224 aa, Rhodobacter sphaeroides ATCC 17029
MSEMLVLDGLTKAYNRGKPGEVTVLRGATLSVGAGEVVALVAPSGAGKSTLLHIAGLLDTPDEGRVAIGGTEMAGLGDRARTGTRRREVGFIYQFHHLLPEFTALENVVLPQLANGVARTAAVARARDLLRRVGVGAREGHRPAALSGGEQQRVAFCRALANAPRLLLADEPTGNLDPGTSDQVFGVLMDLVRGTGLSALIATHNLELAARMDRVVRLEAGRVV

SEQ ID NO: 9223 - protein, 249 aa, Burkholderia mallei NCTC 10247
MNDRVFEQTMNQNHQDGGARECVLEARGVTKTFVQGGFNVQVLDNAQVSVRRGEKLAIVGASGSGKSTLLHVLGGLDEPSAGQVSLLGKPFTQLAERERNELRNRALGFVYQFHHLLPEFTALDNVAMPLRIRRMSTEEARRHAREMLEQVGLGARAKHRPGELSGGERQRVAIARALVTKPACVLADEPTGNLDGSTADHVFHLMLELSRTLDTSFVIVTHDPDLAARCDRILRLRDGVLHEEPAVPV

SEQ ID NO: 9224 - protein, 249 aa, Burkholderia pseudomallei 668
MNDRVFEQTMNQNHQDDGARECVLEARGVTKTFVQGGFNVQVLDNAQVSVRRGEKLAIVGASGSGKSTLLHVLGGLDEPSAGQVSLLGKPFTQLAERERNELRNRALGFVYQFHHLLPEFTALDNVAMPLRIRRMSTEEARRHAREMLEQVGLGPRAKHRPGELSGGERQRVAIARALVTKPACVLADEPTGNLDGSTADHVFHLMLELSRTLDTSFVIVTHDPDLAARCDRILRLRDGVLHEEPAVPV

SEQ ID NO: 9225 - protein, 249 aa, Burkholderia pseudomallei 1106a; identical to SEQ ID NO: 9223

SEQ ID NO: 9226 - protein, 224 aa, Rhodobacter sphaeroides ATCC 17025
MSEMLVLDGLTKAYNRGKPGEVTVLRGATLSVGTGEVVALVAPSGAGKSTLLHIAGLLDTPDEGRVAIGGMAMEGLGDRARTEARRREVGFIYQFHHLLPEFTALENVVLPQLANGVARREAEARARDLLGRVGVGAREGHRPAALSGGEQQRVAFCRALANAPRLLLADEPTGNLDPGTSDQVFGVLMDLVRGTGLSALIATHNLELAARMDRVVRLDAGRVV

SEQ ID NO: 9227 - protein, 230 aa, Geobacter lovleyi SZ
MSSLLEVTGLCKDYRMGSDSVQVLKGIDLDISAGTTTALVGASGAGKSTLLHILGALDRPSSGTVTYKGQELFTRSDRELADFRSRTIGFVFQFHHLLPEFTALENVMMPALIARRENHLAHQQARTLLTEVGLEHRLNHRPGELSGGEQQRVAIARALVMEPELLLADEPTGNLDAKTSEAIYELLVKIQKQTGISMVVVTHNERIAARMERVVRLLDGLILPCTTEDM

SEQ ID NO: 9228 - protein, 252 aa, Pseudomonas syringae tomato DC3000
MSNDRPLIFVDLDDTLFQTARKTPADIEKHVATLDISGNANGYMTNVQKSFAHWLLAHADVVPVTARSVEAYSRVKLPFTAGAICSHGGVMLDVMGRLDPDWNEQMKQTLASYQSRLHELSAATLAIGQEMGFSLRGWVVEEAQLFHYVVTKHNESDDSILTKVLAEMQARGLLDGMHIHGNGNNLAFLPEGLAKRYAVQEWLRRDLAINGERPVLGFGDSITDLGFMDECHWWATPARSQLAKMFVGAAHE

SEQ ID NO: 9229 - protein, 252 aa, Pseudomonas syringae pv B728a
MSNDRPLIFVDLDDTLFQTARKTPAGIEKHVATLDITGKANGYMTNVQKSFAHWLLAHSDVVPVTARSVEAYSRVKLPFTSGAICSHGGVMLDVMGRLDHDWNEQMKRTLASYQSRLHELSATTLAIGQELGFSLRGWVVEEAQLFHYVVTKHNESDDSILGKVLAEVQARGLLDGMHIHGNGNNLAFLPEGLAKRYAVQEWLRRDKAINGERPVLGFGDSITDLGFMDECHWWATPARSQLAKMFVGAAHE

SEQ ID NO: 9230 - protein, 269 aa, Psychrobacter arcticum 273-4
MTFLFFQPSSNIIKPYALMDLDDTLFQTQRKIDAWELPTTEPENLVCATVNKQGEPLSFMSQRQAAFFNWLLASTELIAVTARDRLEIKRVKLLFNSWQVLTHGAVILTSDGEPLSTWQQHMYNALIPLQDKINQLTEWVNSYSKESDRTHNDLKLTPHTDTFIDSELTIYLAIKHTQKDHQALAELATQLPTLIPDFDAHFYVHVNANNLAILPHAVHKRHAVQFLLEQHLDHQRPSFGFGDSLADLPFLQLLDWYGMPNHGQLHTQQ

SEQ ID NO: 9231 - protein, 247 aa, Nitrosococcus oceani ATCC 19707
MERSVFIFSDLDDTLLQTQRKCGVSGPLTEAAVDREGRPLSFHSQEQLLLLRLFKACTLIPVTGRNLEALGRIRSPLFSSYRVTSHGALVWDANNALIPEWESTIRGEALIWEPRMQRLLAVMEGYQRAEQVENLRFRIIYDAQIPVYLSIKGSPGQLSAVEEIVAPVWVQEMGGKFHRNDHNMALLPPYADKGRAVKYIMTLIRQRCEGPPLFIGMGDSLTDIPFLRACHYALTPQNSQIQQEAWM

SEQ ID NO: 9232 - protein, 252 aa, Burkholderia 383
MSGNRPLAFVDLDDTLFQTARKMAEGVPRTTATLDVQGQPNGFMNPVQHAFITWLLATADVVPVTARSVEAYGRVMLPFAEGAICSHGGVMLRPDGSLDRSWHGQMVEALRSVQDRLPALSEATLGIGRALGYALRSWVVEEEGLRHYVVVKHNESDDSVLAEVLAEVRSRRMLDGMHVHANGNNLAFLPTGLAKRAAVHEWLRRDREIHGERPVLGFGDSITDLGYMDLCHMWATPARSQLANWVTGTIHG

SEQ ID NO: 9233 - protein, 254 aa, Rhodospirillum rubrum ATCC 11170
MRRVVFVDLDDTLFQTARKNPGAQTLAALDKDGKPLSFQSTRQVAFLEWLSADAVIVPVTGRSVEAFRRVTLPLGPRAICSFGGVILGADGLPHPEWHRQMSQKAQATARVMELLDDMVAQVLARTGVDARHHIIHDAELALYLSIKHNGGSAEETARLAQALAPAVPEGWTTHLNGANMALLPPFLGKRAAVAFFLETQLGDGPLLTIGFGDSLTDLGFMSLCDYALTPSRSQILGFLNTTWPAVAAMADSAA

SEQ ID NO: 9234 - protein, 253 aa, Psychromonas ingrahamii 37
MTQSSRIFVFTDLDDSLFSSKRKHTKTADSQITSVNKQGEIESYATLQQQKLVQMLAALKASFIAVTGRRTSAYKHCIIDQVTNSEYAIVSHGALILDKKSALLPCWINYLNNTYDMKHWQKKLTQAHCQLINYFSAMNCEARVRLIIDHDICTYICIKIPAHQHQESLLAKINLHLKQLDFSIHGNAGNFAVLPPYASKELAVNYLIKKLNISDKDVVFGIGDSVSDLPFIRNLDFAIFPKSSQIMKAISHV

SEQ ID NO: 9235 - protein, 251 aa, Polaromonas naphthalenivorans CJ2
MKKFLFVDLDDTLFQTPGKCADEKDLHPAAYLKDGSVCSFSTPRQRAFFALMNKEMTLIPATARNRDALSRVDLPFSSHAIIDYGGVVLTPDGAPDGEWLDLMRADMALALGGLKEAIDVIDRYSASVGLKGRARLIEDYATPFYIVVKDPDKQAERLESIEREALTDWIASPTGQDFYIHRNGNNLAVLPKALNKARAVHYLRQKLQTEHGDIMTLGMGDSKSDARFMAACDYAIVPSGTQLSSLTVGAL

SEQ ID NO: 9236 - protein, 284 aa, Psychrobacter PRwf-1
MTINTHSLTPFMPDSLIIKPYALMDLDDTLFQTQRKIAAWQLPTAEPHHLVYAAVNKQGEPLSLMTQRQQLFFNWLLSSTELIVVTARDRHEIKRVVLNFSSWQVLTHGALILQPSGEPLKAWQHQMGAILAPLQAKLQQLIAIIEAYNHRQQGPLRLALHHDDFVAPGTDSSDDSLSEMLIYLAIKHHQKDAMALQQFGEWLLAEHPQLADDFYIHSNANNLAILPKGIHKRHAVAYLLEQHLDHARPSFGFGDSLADLPFLQQLDWYGTPNHGQLHDHIHVL

SEQ ID NO: 9237 - protein, 270 aa, Yersinia pseudotuberculosis IP 31758
MNKPVFLCDLDDTLFQTRRKMVDELDLPPFRVGALDRSLTPRSFMTEEQSMLVDWLLEHAEFIPVTARGTEEISRVNIPFSSWAITTHGAVILTPDRQPDAGWQDTVLTNLQPYRDRLIAMESRINDMMAERGLNAWCRINYEYGDTPVYFVMKHRDSTQIAELYAFNDQLESLFSTDGFYIHRNSNNIAWLPVCIEKGLATTYLLDKLRHEHGAFPVLGFGDSLSDFSFMRHCHWFGMPAKSQFSQALTSHLFDNTTFNKNNVNGDNDA

SEQ ID NO: 9238 - protein, 270 aa, Yersinia pestis Angola; identical to SEQ ID NO: 9237

SEQ ID NO: 9239 - protein, 270 aa, Yersinia pseudotuberculosis YPIII; identical to SEQ ID NO: 9237

SEQ ID NO: 9240 - protein, 257 aa, Escherichia coli O157 H7 EC4115
MNKPVVLSDLDDTLFQTRRKMVDELALEPFRTGAVDRTLNPRSFMTEEQSMLVDWLLEQAELIPVTARGTEEISRVRIPFHSWAITTHGAVILTPEGKPDEEWKAHMLGQLAPYQEKLTSMQRLITEMMDAKGINAWARLNFEYGETAVYMVMKHRDSTRLDELNAIADEIETVFPTEGFYIHRNSNNVAWLPTPVEKGLAVSWLLEKLRAERGVFPVIGLGDSLSDHRFMKLCSWFGIPRQSQFADAISQRIFGEN

SEQ ID NO: 9241 - protein, 155 aa, Thiobacillus denitrificans ATCC 25259
MNALRRNVLKSAAGAGTVAVAVAAGLLKPTQALAAWNKSAFEAKNVADAMKGLGSSGPSDSKDIMIKAPDIAENGAVVPVEITSKLPDTTSIAILAEKNASPLVAEYALAGGTQGYVSTRIKMGQTSLVRAVVKAGGKSYTAAKEVKVTIGGCGG

SEQ ID NO: 9242 - protein, 156 aa, Magnetococcus MC-1
MFDVTNPMLTRRSLMAGAGSVALLAMGTAKNAQANGDKVLANIKEHMGSSAYAESSAIKIDAPIIAENGAMVPVKITIDHPMDADNYIQTIAVFVDNNPTPFAGLYSLTPANGKAFVSSRLKIGKTSQVRAIAKTNTGKLIGASKEVKVTIGGCGG

SEQ ID NO: 9243 - protein, 140 aa, Paracoccus denitrificans PD1222
MILSRREALWIGFGGLAAAVLPGKAALAATVDELTATFTGGAAVGEGGLTLTAPEIAENGNTVPVEVNAPGAVAVMLLASGNPEPAVATFTFGPAAAEQRAATRIRLAQTQDVIALAKMGDGSVVRAQTTVKVTIGGCGG

SEQ ID NO: 9244 - protein, 161 aa, Polynucleobacter necessarius asymbioticus QLW P1DMWA 1
MMKPKLICQSNRRQWLKQFQKIGVFALGAWLSPLAVFAKKADAAKAIQEITGGKSVQDGRVTLVIPPLVENGNLVVLKVSVDSPMTANDYVKSIHVIAEGNPFPNIFTAYLTPRSGTATLTTRVRLADSQTVWAIAQMNDGSFWQGHADTLVTLSACTELV

SEQ ID NO: 9245 - protein, 138 aa, Rhodobacter sphaeroides ATCC 17025
MRLSRRDTLVLGMGGLAALTLPMPALAAADEAIAAFTGGAATGSGGITLTAPEIAENGNTVPVTVDAPGAAAIMLVATGNPEPAVATFTFGPAAGSQMAATRIRLAKTQDVVAIARMPDGSFVQASATVKVTIGGCGG

SEQ ID NO: 9246 - protein, 150 aa, Bradyrhizobium BTAi1
MGAINRRQAFLLGGGFVALTVLPMAANAEPSNDAAELIKKFTGGKEAAKGKITLDLPEIAENGNTVPLALTVESPMTAENYVKEVLFVADGNPNAGVATLMFTPMSGKAEASIRIRLAQTQNVIAVAKMSDGSLFTERKTVKVTIGGCGG

SEQ ID NO: 9247 - protein, 138 aa, Dinoroseobacter shibae DFL 12
MEFTRRETMAIGAGAALAAVLPGVVSAAVKASIDEFTGGAEVGTGGVTLTAPEIAENGNTVPISVSAPGATAILVLALGNPTPAVAEFKFGPLAGDQSASTRIRLAGTQEVAAIAKMADGTFSSETKTVKVTIGGCGG

SEQ ID NO: 9248 - protein, 156 aa, Methylobacterium populi BJ001
MTSAKIPALNRRQALAFGTGAVVATAFAFRAGPALAAKPATDEAIKAFTRGKEPVRGKVKLELPEIAENGNTVPMTVSVDVPMTPESYVEEVMIVAEGNPNPGVISFHFTPSSVAEANTRIRLAETQNVIAVARMNDGSVFSDVRQVKVTIGGCGG

SEQ ID NO: 9249 - protein, 153 aa, Methylobacterium nodulans ORS 2060
MTGPDRRSFLAGGAGLLAVALVRPAEAVERPPREPTEAAIRRFAGDAPIHPGRVALDLPPLVENGNAVPLTVTVESPMSAADHVRRIAVFNDKNPQPNVLTVHLGPRAGRAAISTRIRLADSQTVTAIAEMSDGTYWSATADAIVTLAACVEG

SEQ ID NO: 9250 - protein, 309 aa, Yersinia pseudotuberculosis IP 31758
MNSPDIALIKTYLLTLQDNICGALAQADGHAEFTEECWVREEGGGGRSRVLVNGAVFEQAGVNFSHVSGAMLPASATAHRPELAGRSFQALGVSLVIHPLNPYLPTSHANVRFFIAEKPGEDAVWWFGGGFDLTPYYGFEEDAIHWHQVAHSLCQPFGEQIYPRYKKWCDDYFYIKHRQEARGIGGLFFDDLNSPDFMTCFNFTQAVGDGFLAAYMPIVARRKALGWGDRERQFQLYRRGRYVEFNLVWDRGTLFGLQTGGRTESILMSLPPLVRWEYNYQPEADSAEAALYRDFLPVKDWLAIKGETH

SEQ ID NO: 9251 - protein, 306 aa, Serratia proteamaculans 568
MSLSTIAEVKTFLLALQDRICTQLAQADGSAVFNEDRWTREEGGGGRSRVLTEGAVFEQAGVNFSHVSGATLPASATAHRPELAGRSFQAMGVSLVIHPRSPYIPTSHANVRFFIAEKPGEEPVWWFGGGFDLTPFYGFEEDAVHWHRTAERLCAPFGEQVYPKYKKWCDDYFFIKHRNEARGIGGLFFDDLNTPDFATCFAFTQAVGEGFLEAYLPIVEKRKTLSWGDHERQFQLYRRGRYVEFNLVWDRGTLFGLQTGGRTESILMSMPPLVRWEYNYQPAEDSPEAALYRDFLPVRDWLKEPE

SEQ ID NO: 9252 - protein, 309 aa, Yersinia pestis Angola
MNSPDIALIKTYLLTLQDNICAALAQADGHAEFTEECWVREEGGGGRSRVLVNGAVFEQAGVNFSHVSGAMLPASATAHRPELAGRSFQALGVSLVIHPLNPYLPTSHANVRFFIAEKPGEDAVWWFGGGFDLTPYYGFEEDAIHWHQVAHSLCQPFGEQIYPRYKKWCDDYFYIKHRQEARGIGGLFFDDLNSPDFMTCFNFTQAVGDGFLAAYMPIVARRKALGWGDRERQFQLYRRGRYVEFNLVWDRGTLFGLQTGGRTESILMSLPPLVRWEYNYQPEADSAEAALYRDFLPVKDWLAIKGETH

SEQ ID NO: 9253 - protein, 309 aa, Yersinia pseudotuberculosis YPIII; identical to SEQ ID NO: 9252

SEQ ID NO: 9254 - protein, 311 aa, Dickeya dadantii Ech703
MTTMNSPDIDAIKHFLLTLQDSICRQLEQVDGNAVFQEDAWQHASGGGGRSRVLRQGTVFEQAGVNFSHVSGAALPPSASMHRPELAGRRFQAMGVSLVIHPLNPYVPTSHANVRFFIAEKDGEPPVWWFGGGFDLTPFYGFKEDAIHWHQTAFALCRPFGDDVYPRYKKWCDDYFFLKHRGEARGIGGLFFDDLNAPDFDTSFAFMRAVGEGFLHAYLPIVNRRKPLAWGDRERQFQLYRRGRYVEFNLVWDRGTLFGLQSGGRTESILMSMPPLVRWEYQYQPEADSPEAALYRDFLPARDWLSTEGEE

SEQ ID NO: 9255 - protein, 312 aa, Dickeya zeae Ech1591
MSSPDITAIKHFLLKLQDTLCRQLELADGSATFIEDAWQHASGGGGRSRVLRQGRVFEQAGVNFSHVSGASLPPSASTHRPELAGRSFQAMGVSLVIHPLNPYVPTSHANIRFFIAEKPGEPAVWWFGGGFDLTPFYGFEEDAVHWHQTAFDLCRPFGDDVYPRYKKWCDDYFFLKHRNEARGVGGLFFDDLNTPDFDTSFAFMRAVGEGFQHAYLPIVNRRKDIPWGERERQFQLYRRGRYVEFNLVWDRGTLFGLQSGGRTESILMSMPPLVRWEYQYQPEPDSPEAALYRDFLPPRDWLGLNTPSEPHE

SEQ ID NO: 9256 - protein, 310 aa, Pectobacterium carotovorum PC1
MSDVNAVKHFLLSLQKDICQQLAAIDGGADFAEDEWQRAEGGGGCSRVLSGGRVFERAGVNFSHVTGKSLPPSASTHRPDLAGRSFQAMGVSLVIHPLSPYIPTSHANVRLFIAEKPGEEPVWWFGGGFDLTPYYGFKEDAVHWHQTAHDLCQPFGDEVYPRYKKWCDDYFFLKHRNEARGIGGLFFDDLNEPDFATSFAFIRAVGNGFLDGYLPIVERRKDLPWGEREREFQLYRRGRYVEFNLIWDRGTLFGLQSGGRTESILMSMPPLARWEYQHQPEPGSPEALLYQDFLPARDWLAESHTHNKEA

SEQ ID NO: 9257 - protein, 337 aa, Desulfovibrio desulfuricans G20
MKLPVLALTMGDPAGIGPEITAKALGRDEIHTMCIPLVVGDMALMQAHERYMNGRRCILVDGVEALDTLPADGVAVFQPHGPLRGVVAGTLSAEAGRAAAAYVYGAIELAKRGDIQGIVTAPLNKEALHMGGDTHPGHTELLAESFGVRNYAMVLAAEDRYVFHVTTHQSLRSAIDSLTVDAVYQRIRLAHLLATALGTPQETVAVAGVNPHAGEGGMFGTEERDIITPAVQKAVAEGIPAEGPVPADVLFPRMVRGQYRFAIAMYHDQGHAVFKSLYFDTGVNITIGLPVIRTSVDHGTAFDIAGKGIASEESMIEAVRAAARLGNSWAHISRSAM

SEQ ID NO: 9258 - protein, 331 aa, Rhodoferax ferrireducens T118
MYRPLIAITMGDAAGIGPEIIMKSLAKPALYETCRPLVIGDAARLRQAGALCGVDLQVKVRTRIEEATFTFGQVDCLDLGLIPADLPFGKLSAIAGDAAYRYVAKAVELIKADIADAICTAPLNKEALHAGGHLFPGHTEMLAHLTGTPEVSMMLVAPKLRVIHVTTHMGLLDAIDRIEPGLVERTIARGHDTLVRAGIPQPRIGVCAINPHAGENGLFGRGEEEQKITPAITACLARGWQIEGPLPADTLFFRAGRGDFDLVVAMYHDQGHGPIKVLGIEAGVNVTVGLPVIRTSVDHGTAFDIAGQGVADERSMLEALRQAIELATRRG

SEQ ID NO: 9259 - protein, 335 aa, Rhodopseudomonas palustris BisB18
MTRPTIAITMGDPAGIGPEVIMKALAHPDAQKNCNALVVGDANRLRKAGKICGLSLQVDALSDAKDANFASKAVQCVDLKIVPDDLPFGKMSPVAGEAAFRFIEKAVQLVQAGVAQGICTAPLSKEALHAAGHKFPGHTEMLAHLTGTPEVSMMLVSPKLRVIHVTTHIGLIDAIAKIEPGLVERVITRGHEVLVRAGIKNPKIGVCAINPHAGENGLFGRGEEAEKITPAIEACQRKGWDVRGPLPADTLFFLAGRGDFDMVVAMYHDQGHGPIKVLGLEAGVNITVGLPVIRTSVDHGTAFDIAGKGIADERSLIEALRQAVELAPKQVAEPV

SEQ ID NO: 9260 - protein, 333 aa, Cupriavidus metallidurans CH34 uid250
MSDYIPVIGITMGDATGIGPEVIVKSLAHETVYAQCRPLVIGDARRLEQAGRLVNSALKIRAIQSPEEARFEPGTIDCIDLGLIPEDLPFGKLSAVAGDAAFRYIERAVRLAQEEKIDAICTAPLNKEALHAGGHKFPGHTEMLAHLTGTPEVSMMLVAPKLRVIHVTTHIGLLDAIRKIEPGLVQRTIERGQVTLQRAGIAAPRIGVCGINPHAGENGLFGHGEEEQKIIPAVEALRARGWDVEGPLPADTLFYRAGRGDFDLVVAMYHDQGHGPVKVLGLEAGVNITVGLPVIRTSVDHGTAFDIAGKGIADERSLLEALRQGAELATRRA

SEQ ID NO: 9261 - protein, 341 aa, Burkholderia cenocepacia AU 1054
MDNRPIIGITMGDAAGVGPEIIMKSLAHASVYEECRPVVVGDAARLRDAGRRAGVDLEVSAIGRPSEGAFRVGVVDCIDLALIPADLPYGKLSAIAGDAAYQYIARTVELTSKGELDAICTAPLNKEALHAGGHIFPGHTEMLAHLTGIDEVSMMLVAPNLRVIHVTTHIGLLDAIRKIEPGLVQRTIERGHDTLVRAGIANPRIGVCGINPHAGENGLFGYGEEEEKIVPAVEVLQARGWDVEGPLPADTLFFRAGRGDFDVVVAMYHDQGHGPVKVMGLEAGVNVTVGLPVIRTSVDHGTAFDIAGKGIADERSLLEAFRQAVDLATRRNESSPVASAA

SEQ ID NO: 9262 - protein, 339 aa, Rubrobacter xylanophilus DSM 9941
MRPPVVALTMGDPAGIGPEIIARAFAEPGFSEENRVVVVGDGARLERAAALLRLPLRIETVSGPEEARFRPGSVDLIPASRLPADLPFGRLDPRAGDAAFEYLRRAVGLALEGRVSAVATAPLNKEALHLAGHRYPGHTEILAELTGTRDYAMMLVADGLRVIHVSTHVPLREAIELVRPERELAVIRLAHGAMRRIGLESPRVAVAGLNPHAGENGLFGEEDREHIAPAVERARSEGIDASGPWPPDTVFLRARRGEFDIVVVQYHDQGHIPAKLLGFEGGVNVTVGLPFFRTSVDHGTAFDIAGTGRADHSSLLAALRLARELAGAQEEDRQKKRRG

SEQ ID NO: 9263 - protein, 340 aa, Moorella thermoacetica ATCC 39073
MVKPLIAITVGDPCGIGPEITAKALAIPEIYNLCRPLAIADAGLMGEAIKIAGVNLSVRAVTSPGEGRYEYGTIDVLDMQNVDLNQLQYGKVTRMGGEASFQYITRAIELALAGEVDAVTTGPINKEAINLAGHHYSGHTEIFADLTKTQDYCMMLVDKNFRVSHVTTHVAFSQVPSLIKKERVLTVIKLTNDALLKMGISMPRIAVAGLNPHAGEDGLFGREEIEEIGPAITAAREQGIQVDGPVPPDTIFVKLQGGQYDAVVAMYHDQGHIPTKLIGFKYDNATGKWGSVAGINITLGLPIIRTSVDHGTAFGKAGKGTANPESMVDALKMGAIMTRT

SEQ ID NO: 9264 - protein, 341 aa, Burkholderia cenocepacia HI2424; identical to SEQ ID NO: 9261

SEQ ID NO: 9265 - protein, 333 aa, Burkholderia multivorans ATCC 17616 JGI
MSNYLPVIGITMGDAAGVGPEIIVKSLAHDVVYRQCRPLVIGDARRLERANEIVGGTTKIRRIQEAADARYEPGTIDCIDLDLIPADLPFGRLSAVAGDAAYQFIARAVKLAEAGQIDAICTAPLNKEALHAGGHKYPGHTEMLAHLTGVDEVSMMLVAPQLRVIHVTTHIGIIDAIRKIEPGLVQRTIERGHATLVKAGIAKPRIGVCGINPHAGENGLFGYGEEEEKIVPAVALLQERGLDVTGPLPADTLFFRAGRGDFDLVVAMYHDQGHGPVKVLGLEAGVNVTVGLEVIRTSVDHGTAFDIAGTGVADERSLLEALRQGAELATRRG

SEQ ID NO: 9266 - protein, 341 aa, Burkholderia cenocepacia MC0 3; identical to SEQ ID NO: 9261

SEQ ID NO: 9267 - protein, 339 aa, Burkholderia ambifaria MC40 6
MDNRPIIGITMGDAAGVGPEIIMKSLAHASVYEQCRPVVIGDAARLRDAGRLAGVDLDVRAVSRPADGAFRVGVVDCIDMALIPADLPYGKLSAVAGDAAYQYIARTVELTSKGELDAICTAPLNKEALHAGGHIFPGHTEMLAHLTGIDEVSMMLVAPNLRVIHVTTHIGLLDAIRKIEPGLVQRTIERAHDTLVRAGIANPRIGVCGINPHAGENGLFGYGEEEEKIVPAVQILQARGWDVEGPLPADTLFFRAGRGDFDVVVAMYHDQGHGPVKVMGLEAGVNVTVGLPVIRTSVDHGTAFDIAGKGIADERSLLEAFRQAVELATRRNEPAPVAA

SEQ ID NO: 9268 - protein, 341 aa, Opitutus terrae PB90 1
MTKSALPRIAVTMGDPAGIGPETCLRLLNNPELAQVGVPVVFGDVGVLRRVSALLGIPFYAPILKPDTWTQGFAEVIQPSVLDLGLLAADDVVPGRVDARCGEAAFRSVIAAIEAALAGQVDAVATAPLNKEAMHLAGHNYPGHTEIFAERMRAARSCMMLTSPELTCSFVTVHVGYGEVPALLNVPRIVDVIELTAEAMQRIRGRAPRLAVCGLNPHAGEHGLFGQREEERFIAPAIAAARSKGIEVIGPLPPDTAFLASRRKQTDAFVCMYHDQGHIPLKALAFDSAINTTLGLPVIRTSVDHGTAFDIAWQGRANPNSLFEAVRLAAKLSAKEPATHR

SEQ ID NO: 9269 - protein, 342 aa, Burkholderia phymatum STM815
MNSTYSRDQIMSNYLPVIGITMGDAAGVGAEVVVKSLAHASVYAQCRPLVIGDAKRLERANQIVGGEMKIRRIEDASEARYEQGTIDCIDLGLIPDDLPFGQLSAIAGDAAYQYIKRAVELAQSGKIDAICTAPLNKEALHAGGHKYPGHTEMLAHLTGVDEVSMMLVAPQLRVIHVTTHIGIIDAIRKIEPGLVQRTIERGNATLVKAGIERPRIGVCGINPHAGENGLFGYGEEEEKIIPAVTLLQERGLDVTGPLPADTLFFRAGRGDFDLVVAMYHDQGHGPVKVLGLEAGVNVTVGLEVIRTSVDHGTAFDIAGKGVVDEGSMLEALRQGAELATRR

SEQ ID NO: 9270 - protein, 327 aa, Salmonella enterica serovar Newport SL254
METKTVAITMGDPAGIGPEIIVKALSEDGLNGAPLVVIGCLATLKRLQAKGITPNVELRAIERVAEARFAPGIIHVIDEPLAQPEALEAGKVQAQAGDLAYRCVKRATELALRGDVQAIATAPLNKEALHLAGHNYPGHTELLATLTHSRDYAMVLYTDKLKVIHVSTHIALRKFLDTLSTARVETVIGIADTFLKRVGYVKPRIAVAGVNPHAGENGLFGDEETRILTPAITDARAKGMDVYGPCPPDTVFLQAYEGQYDMVVAMYHDQGHIPLKLLGFYDGVNITAGLPFIRTSADHGTAFDIAWTGKAKSESMAVSIKLAMQLA

SEQ ID NO: 9271 - protein, 327 aa, Salmonella enterica serovar Schwarzengrund CVM19633; identical to SEQ ID NO: 9270

SEQ ID NO: 9272 - protein, 327 aa, Salmonella enterica serovar Agona SL483
METKTVAITMGDPAGIGPEIIVKALSEDGLNGAPLVVIGCLATLKRLQAKGITPNVELRAIERVAEARFAPGTIHVIDEPLAQPEALEAGKVQAQAGDLAYRCVKRATELALRGDVQAIATAPLNKEALHLAGHNYPGHTELLATLTHSRDYAMVLYTDKLKVIHVSTHIALRKFLDTLSTTRVETVIGIADTFLKRVGYVKPRIAVAGVNPHAGENGLFGDEETRILTPAITDARAKGMDVYGPCPPDTVFLQAYEGQYDMVVAMYHDQGHIPLKLLGFYDGVNITAGLPFIRTSADHGTAFDIAWTGKAKSESMAVSIKLAMQLA

SEQ ID NO: 9273 - protein, 327 aa, Salmonella enterica serovar Dublin CT 02021853; identical to SEQ ID NO: 9270

SEQ ID NO: 9274 - protein, 336 aa, Methylobacterium nodulans ORS 2060
MSAAVKPVIGVTMGDAAGIGPEIVVRALVEPEVREACHAIVIGDAGIMRDAVALTGLPCEIRAVSSVAEAEFRDGTIDVLDLRNIARSDFEPGRISAACGRAFVEYIRRAARMALSGEIDAVASAPTNKEAMHAAGEIYPGQTEIFAEESRSTDPFTILTGGKMRVFLVSSHVSLSQAIALVTQPRIELVIRKAVASLKELWGIDDPLIGVAGLNPHAGDGGLFGREEIEHVIPVLERLRAEGIRIEGPGPADSVYDRADRGAYDGVIGMYHDQGVIPLKRYGYVTVISGTPIIRTTAGHGTAYDIAWKGIGRANVMQRAVVLAAELAASRAARAR

SEQ ID NO: 9275 - protein, 344 aa, Pedobacter heparinus DSM 2366
MKTNNKKPILGITMGDPASIGPEVAVKALANAGIYEICKPLLVGDAEICKDAIRFCGLDLVVNAVKDVKDAKFEFGSIDVYDLEYASADIVTGQNSVAAGAAAFNTVVKVIDLAMKGLVDATVTGPINKESIHLAGHKFSGHTEIYAHYTDTKKYGMLLVEDDLRVIHVSTHVSLRQACDLVKKQRILDTIELIVSACRQLGISNPKIGVAGLNPHASDGGLFGEEEQLEIIPAIEEARRRGYTVEGPVPADTLFPKAIGGVYDGIVAMYHDQGHIPFKVVGFNWDKSARQMKSVRGVNITLGLPIIRTSVDHGTAMEIAGRGIASADAMNLAIEYAVNMVRTK

SEQ ID NO: 9276 - protein, 326 aa, Dickeya dadantii Ech703
MSKIIAVTMGDPAGIGPEIIIKSLAEGELSGAPVVVVGCVQTLRRILALGVVPQVELNEIANPAQARFAPGVVNVIDEPLADPAGLEPGRVQAQAGDLAYRCVKRATELAMAGEVHAIATAPLNKEALHSAGHLYPGHTELLAKLTNSRDYAMVLYTDRLKVIHVTTHIALRKFLDTLNRERVETVIGMADTFLKRVGYDKPRIAVAGVNPHAGENGLFGDEEINIVSPSIEAMKAKGLDVYGPCPPDTVYLQAYEGQYDMVVAMYHDQGHIPLKLLGFYDGVNITAGLPFIRTSADHGTAFDIAWTGKAKAESMAVSIKLATQLA

SEQ ID NO: 9277 - protein, 326 aa, Dickeya zeae Ech1591
MSKIIAVTMGDPAGIGPEIIIKSLAEGDLSGAPAVVVGCVQTLRRILALGVVPQVELNEIERPADARFAPGVINVINEPLDDPQGLKQGVVQPQAGDLAYRCVKRATELAMAGEVHAIATAPLNKEALHSAGHLYPGHTELLAKLTNSRDYAMVLYTDKLKVIHVTTHIALRKFLDTLNRERVETVIAMADTFLKRVGYQAPRIAVAGVNPHAGENGLFGDEEIKIVGPSIEAMKAKGIDAYGPCPPDTVYLQAYEGQYDMVVAMYHDQGHIPLKLLGFYDGVNITAGLPFIRTSADHGTAFDIAWTGKAKSDSMAISIKLAMQLA

SEQ ID NO: 9278 - protein, 326 aa, Pectobacterium carotovorum PC1
MSKIIAVTMGDPAGIGPEIIIKSLAEGELSGASAVVVGCVQTMQRILALNVVPAVELKIIDKPADAVFAPGVINIIDEPLEDPQALKPGVVQAQAGDLAYRCIKKATALAMAGEVHAIATAPLNKEALHSAGHIYPGHTELLAKLTNSRDYAMVLYTDKLKVIHVSTHIALRKFLDTLNRERVETVIDMADVFLKRVGFTHPRIAVAGVNPHAGENGLFGDEEIKIVSPSVEAMKAKGIDVYGPCPPDTVYLQAYEGQYDMVVAMYHDQGHIPLKLLGFYDGVNITAGLPFIRTSADHGTAFDIAWTGKAKSESMAISIQLAMQLA

SEQ ID NO: 9279 - protein, 188 aa, Shewanella oneidensis
MANETRGRRSKVDLLPANIRKRLDSGLRDGSIQQTELLEEINALIKAAGLPKDNLLSRAGINRYATKMEAVGKSLREMREITQVWTAELGDKPTGEVTKFILEIGRSQLLKAMLNESESDMADVGLIKDAMLAVQRLESAAMASHKREKEIRQAFAAEAAHAAEKVAKSAGLTSDAVAMLKREILGIA

SEQ ID NO: 9280 - protein, 185 aa, Methylobacillus flagellatus KT; identical to SEQ ID NO: 5321

SEQ ID NO: 9281 - protein, 173 aa, Polaromonas JS666
MTQRSKVVTLPEATRAELDRRLITEGFRGYDELELWLRELGYEIGKSSIHRYGTKLEQRLDQLKRATDQAKALVAAAPDDAGDMSQAVLRLMQEKIFSALMEMEVDPDEQSLGGLAKALAPLVRANIAQQKFASEVKEKARSAAEAVDKLARKGGLTDDTVDAIRRQILGIAA

SEQ ID NO: 9282 - protein, 193 aa, Vibrio cholerae O395; identical to SEQ ID NO: 5323

SEQ ID NO: 9283 - protein, 189 aa, Shewanella baltica OS185; identical to SEQ ID NO: 5324

SEQ ID NO: 9284 - protein, 189 aa, Shewanella baltica OS195; identical to SEQ ID NO: 5326

SEQ ID NO: 9285 - protein, 183 aa, Thioalkalivibrio HL EbGR7; identical to SEQ ID NO: 5330

SEQ ID NO: 9286 - protein, 194 aa, Agrobacterium vitis S4; identical to SEQ ID NO: 5331

SEQ ID NO: 9287 - protein, 296 aa, Desulfovibrio desulfuricans G20
MSLPRGHARLGTTLLRLAPVLVPCGVLFTGGFALTLAQSLGYALPVPAPEGQPSAAAYRMLLQPYYLASFLLSVKVAFLSAAVSVVCGALLAVGVWRLPYRLQQAAVVYKVPLILPHVAVALLCLVFWSRSGLVSSLAWQTGLVTQQADFPAVLYGGSGLGMVLAYVYKEIPFVMLMSYAALKRLDHRLLDTAAMLGAGRLLTWRSVILPHLAPTLHPVFIILFLFAFGGFEVPYLLGESNPGMLSVEIYNLYFQRGLARRPEAMAVLTVMFLFSLVFVALYSRLVRRFGLGERKL

SEQ ID NO: 9288 - protein, 288 aa, Yersinia pseudotuberculosis IP 31758
MKSWRNDLLAWSLMLSGLGTILLLMGSTFYVVVVQSLGYFNLEGESHFSLEFWRDMLQDEVLHSALFYSVKVSVLGAFGSVIFAYPLALWLRKPLIAKEGIIAVLRAPMFIPGMVAAFLFVNIIAYHGVINELLMALGVINEPLRMQNDDFGWGVVILQVWKNLPFALILVGGAVNAIRNDVLDAASNLGANRLRSFTGIVVPLTLPAVQVTLILVFIGALGDFAFFSVAGPRNTYSLARLMQATAMEYGEWNNAAVIAVIIMTTAAIFTLLIATLITPFATRKGDVK

SEQ ID NO: 9289 - protein, 288 aa, Yersinia pestis Angola
MKSWRNDLLAWSLMLSGLGTILLLMGSTFYVVVVQSLGYFNLEGESHFSLEFWRNMLQDEVLHSALFYSVKVSVLGAFGSVIFAYPLALWLRKPLIAKEGIIAVLRAPMFIPGMVAAFLFVNIIAYHGVINELLMALGVINEPLRMQNDDFGWGVVILQVWKNLPFALILVGGAVNAIRNDVLDAASNLGANRLRSFTGIVVPLTLPAVQVTLILVFIGALGDFAFFSVAGPRNTYSLARLMQATAMEYGEWNNAAVIAVIIMTTAAIFTLLIATLITPFATRKGDVK

SEQ ID NO: 9290 - protein, 288 aa, Yersinia pseudotuberculosis YPIII
MKSWRNDLLAWSLMLSGLGTILLLMGSTFYVVVVQSLGYFNLEGESHFSLEFWRNMLQDEVLHSALFYSVKVSVLGAFGSVIFAYPLALWLRKPLIAKEGIIAVLRAPMFIPGMVAAFLFVNIIAYHGVINELLMALGVINEPLRMQNDDFGWGVVILQVWKNLPFALILVGGAVNAIRNDVLDAASNLGANRLRSFTGIVVPLTLPAVQVTLILVFIGALGDFAFFSVAGPRNTYSLARLMQATAMEYGEWNNAAVIAVIIMTTAAIFTLLIATLITPFVTRKGDVK

SEQ ID NO: 9291 - protein, 303 aa, Desulfovibrio vulgaris  Miyazaki F
MAGGATGWVTGWRMAALCPLLVLLVPFLAGVGLTAAQSLGWLLPIQYLPEQGAQGLYAPDVLTGWRQLAQPHMAGSLLLGVRVAGVSALLSVSGGALLAYGVWRLPARMQLAALVFRVPLVLPHIVVAFLAIVFWSRSGLVSAALHQAGIISGQAQFPALLWGGDGMGMVLAYTYKELPFVMLLAVASLRRLDPRLIETARMLGAGRWAVLRDVVVPHLAPVLHASFLILFLYAFGAVEIPLLLGESTPAMPGVAAYDLYFLRSLEDRPVAAALLTLLLLCCAGFVAAYVRLVAGLRGRERQL

SEQ ID NO: 9292 - protein, 284 aa, Agrobacterium vitis S4
MPSLLRRRSIQLLLLLLPGVGYLLFFFGLPLLSALVGSFRLEDGSFTLSWYQRIFTRPSMLRGLSTSIYYGVMPVLVSLALSVPLALLLRKSFIGRKLFSGLYKLPMAVPSIIVGLMIIVVFERGGFFDRLLAPLGFTLPKLVRDDLGAGVIIANSWKQIPFMTLIITSAFAAIPEDIRFAARTLGASRLRTFLAVDVPLAMPGITAAILLTFIGSMGSYAIPDIVGPPTARPLSVLMVQEFKQGRFEQVYAMGMVLSLFAVIVLLTYYALTSRIGAGNARGNA

SEQ ID NO: 9293 - protein, 286 aa, Dickeya dadantii Ech703
MKTTLTAYLLLLPGVGAIVLFMIAVLGMAVSQSVGFFNFAGESGFSLRFWQTMLADEQLWRSFFYSARIATLSALLSVAVAYPLAIWLRKPFPGSDLLQALLKAPLLVHGLTAAFLFVNFIAYQGFLNLALVRLGIGSRPVRLQNDPYGIGVVILQVWKQMPFALLLMSGAVRAVGDTLLEAARNLGAGTWARFHRVVLPLTLRSLQTALVLIFIGAAGDFSFQSVAGPVSVNSMAQFMLRVQQSGAEGWNQAAVVAVMLMALSLLGAGVLAACAGVLVRRSGRGR

SEQ ID NO: 9294 - protein, 284 aa, Dickeya zeae Ech1591
MRASLMAYLLLLPGVGVIVLAMGAVVGMAFSQSLGFFNFAGDSEFSLRFWQTMLADEQLWRSFFYSARIALLSAVLSVVLAYPLAIWLRNPFPGAVTLRAVLKAPLLVPGLTAAFLFVNFISYQGFLNLAMLRLGLTERPIRLQNDANGIGVIVLQVWKQMPFALLLLSGSVQAIGDTLLDAARNLGAGMWVRFRRIVLPLTLRALQTAMMLIFIGAAGDFSFQSVAGPVNLNSMSQLMLRVQQAGTEGWNQAAVVAVMLMLLSLAGAGLLALATGAAVRGIRG

SEQ ID NO: 9295 - protein, 287 aa, Desulfohalobium retbaense DSM 5692
MTLRQILRLAPLLAPFGILLAGGVGLTVAQSLGVLLPVPVPGGPLEGYRAVLSAPGFWETCLFSLGVALASALLSVATGTWLGYALWRLPPQMRRLGIVYKLQLILPHLSVAFVVLLFWSPTGILASVLYQLGLLEAPDQFPNILYSGYGLGMILAYTCKGVPFVMLLVLALLARFDRRQLATARMLGAGWWQTARYVLYPHLRPATHTSFIILFLYSFGAFDIPFILGESRPGMLSIAVFNRYFKSPLDKRPEAMAMLVIMFLFAATFIVLYGRIVRHIDNAARKL

SEQ ID NO: 9296 - protein, 232 aa, Enterobacter sp. 638
MAVNSFNKGAVSPLLSVWRSTLALAGVLLLSACSHDSALPPFTASGYAADQGAVRIWRKDVNGEVHLLSAFSPWHKGNTSTAEYRWQDDALSLIELNIYSKTPEHIRVRFDGRGELSFMQREVDGQKQQLSSDQIALYRYRAEQIRQTSDALRQGRVVLRQGRWHADGTVTTCESQTIKPDLDAWARERIERRQRHSSMEVSVAWLEASEGSQLLLVANEDFCTWQPTEKHF

SEQ ID NO: 9297 - protein, 233 aa, Yersinia pseudotuberculosis IP 31758
MSVKIISRGGIKPLLFMRRVLITFGLTLGLSACSSLSDPPQFSASGYIADSGVVRLWRQDNAQQQPQVLMSVYSPYFGGNTRVTFYEYQNGILREIRRNDLGATPQSVQLRFDEQGQVSFMQRQLASRRESLSADDIAVYQLEAKRILELSRVLRAGDVRLIQGRWQDGMLTTCAGKTLRLNLDDNSQAWLTTRGEKNTQPLGVAWLDSSEGQQLLLVANQDFCRWEPQAGSL

SEQ ID NO: 9298 - protein, 212 aa, Serratia proteamaculans 568
MVIGIAAGLSACSSHSDLPSFSASGYVADQGVMRLWRKDDERHRPLVLMSVYSPYRGPGTVTTLYEYQDGKLRQIKRTDADGDQDSIQLRFADDGGVSFMQRQLATRREQLTADEIALYQYQARRVLELSNALRAGKVKLLQGRWQQGVVQTCDGQTLKPDLDSSAEAWIARRARNSSQPVNIAWLDAPEGRELLLVANDDFCRWEPKEDQL

SEQ ID NO: 9299 - protein, 219 aa, Yersinia pestis Angola
MFMQRVLITFGLTLGLSACSSLSDPPQFSASGYIADSGVVRLWRQDNAQQQPQVLMSVYSPYFGGNTRVTFYEYQNGILREIRRNDLGATPQSVQLRFDEQGQVSFMQRQLASRRESLSADDIAVYQLEAKRILELSRVLRAGDVRLIQGRWQDGMLTTCAGKTLRLNLDDNSQAWLTTRGEKNTQPLGVAWLDSSEGQQLLLVANQDFCRWEPQAGSL

SEQ ID NO: 9300 - protein, 217 aa, Yersinia pseudotuberculosis YPIII
MRRVLITFGLTLGLSACSSLSDPPQFSASGYIADSGVVRLWRQDNAQQQPQVLMSVYSPYFGGNTRVTFYEYQNGILREIRRNDLGATPQSVQLRFDEQGQVSFMQRQLASRRESLSADDIAVYQLEAKRILELSRVLRAGDVRLIQGRWQDGMLTTCAGKTLRLNLDDNSQAWLTTRGEKNTQPLGVAWLDSSEGQQLLLVANQDFCRWEPQAGSL

SEQ ID NO: 9301 - protein, 210 aa, Dickeya dadantii Ech703
MVIALATACSSHSPPPALYAGGYLADRGVVRLWRMDDEQQHTTTLMTVFSPLQGQDTQITRYQFQQGVLRDVQQRHGASASQDQVRLRFDQDGAVNFMQRQLPDRRESLSEDEIALYQFDARRMLEMSDVMRAGNVRLLQGVWQEGRVVACDGKVLKPALDGSSLAWIRQRQQNARAPVSIAWLVSNAGTQLLLVANADLCRWEPTAETL

SEQ ID NO: 9302 - protein, 236 aa, Dickeya zeae Ech1591
MPIQGLSRGAISPLLLFFRRHLRFVVPVLAWLLSACSFQPPTPAVYASGYLADRGVVRLWRKDDAQQHLTTLVTAFSSLQGKEVHITRYRFLQGTLREVQQTTSASSQDEVRLRFDQDGTVSYMQRQLPDRRESLSEDEIALYQFDARRLLALSDSLRAGKVSLMQGRWNAGQVMTCSGQTVRPDLDRSSLAWIAQQSERAAGQLSVAWLVSPEGTQLLQVAEADFCRWEPTAETW

SEQ ID NO: 9303 - protein, 228 aa, Pectobacterium carotovorum PC1
MSVKSLSRGAFSPLLLLRRWCGVGLMLTAVVACSSRTAPPEFFASGYVADRGIVRLWRKDDAQNTTALTTVFNPLQGNALVVTRYTFQQDKLREIQRNQLGTQKEDMRLRFAEDGTVSFMQRQLAERRESVSDDDVALYQFDAKRMLELSDVLRAGKVILKQGKWLEGQVQSCDGTAVRPDFDNDSREWIAEQKMHATRPLNVAWLEAPEGTQLLLVVEDDVCQWQPK

SEQ ID NO: 9304 - protein, 258 aa, Colwellia psychrerythraea 34H
MSKVLQCCQLSKSYIQGDIETKVLNDLELSVDKGELLAVVGSSGCGKSTFLHLAGALDSPSSGKVLINNIDIHQLSDKERAKFRNEHIGFIYQFHHLMMEFNAQENVAMPLMIRGEKPKDALLAAKEMLDQVGLSHRIDYRPSQLSGGERQRVAIARALVTKPSLVLADEPTGNLDSDTAEQIYQLIRSLNKTAQTSFVIVTHDLVLANRMDRQVKLVQGQLRPLSDNSEQALPPTSSITDPANNIKDNEPQANERHV

SEQ ID NO: 9305 - protein, 233 aa, Shewanella denitrificans OS217
MKPASTRLLAINAVSKVFHDGACETQVLHEVNLTVHRGEQLAIVGSSGSGKSTLLHIMGTLESPTSGTVLLEGENLHQLSSKRQAQIRNQDLGFIYQFHHLLPEFSALENVAMPAFIQGKNKAQTLAEAKALLERVGLGHRLTHLPSQLSGGERQRVAIARALINKPKLVLADEPTGNLDAVSGEAVYGLIRELAEQLGTAFVVVTHDANLAARMDRQVNMKDGILSQSETHR

SEQ ID NO: 9306 - protein, 236 aa, Baumannia cicadellinicola Homalodisca coagulata
MNNTPLLKCCQLSKSYQEGEFSSCVLLNVNLTIHTGDMIAIIGPSGSGKSTLLHLLGGLDTPTSGDILFEGKLLKTLSSAACAKLRNQRLGFIYQFHHLLSDFTALENVAMPRMIRGEKAKVAQIAALKMLTMVGLEKRSHQKPSELSGGERQRVAVARALVNNPSLVLADEPTGNLDKRNANMIFELIRSINGKHGTAFIVVTHDLRLAQSLPRQFEMQEGVLMPYGSPLLSSNQ

SEQ ID NO: 9307 - protein, 231 aa, Shewanella baltica OS155
MQDVLLQVQSVSKSYHDGAVTTQVLSNVDLQVFKGEQLAIVGSSGSGKSTLLHIMGTLDEPTAGKVLLLGEDLYQVSSARQAQIRNQDLGFIYQFHHLLPEFTALENVAMPAFIQGKDRKLALADAKALLERVGLGHRMTHIPAELSGGERQRVAIARALINKPKLVLADEPTGNLDANSGDAVYELIRELAEQLGTAFVVVTHDHKLAARMDRQLMMKNGFLQLAAETQV

SEQ ID NO: 9308 - protein, 233 aa, Enterobacter sp. 638
MNKILLQCDNLSKRYQEGNVQTDVLHEVSFSVGEGEMMAIVGSSGSGKSTLLHLLGGLDTPTSGDVIFSGTPLSSMSSTAKADLRNRELGFIYQFHHLLPDFTALENVAMPLLIGKKKPAEINTRASDMLKAVGLAHRGNHRPSELSGGERQRVAIARALVNNPRLVLADEPTGNLDARNADSIFQLLGELNASQGTAFLVVTHDLQLAGRMSRQLEMRDGRLTTEMTLMGAE

SEQ ID NO: 9309 - protein, 231 aa, Shewanella putrefaciens CN-32
MQDVLLQVQNVSKSYHDGAVTTQVLSNVDLQVFKGEQLAIVGSSGSGKSTLLHIMGTLDEPTAGKVLLLGEDLYQVSSARQAQIRNQDLGFIYQFHHLLPEFTALENVAMPAFIQGKDRKQAIADAKLLLERVGLGHRITHIPAELSGGERQRVAIARALINQPKLVLADEPTGNLDANSGDAVYELIRELANQLGTAFVVVTHDHKLAARMDRQLMMKNGYLQVAAETQV

SEQ ID NO: 9310 - protein, 231 aa, Shewanella baltica OS185; identical to SEQ ID NO: 9307

SEQ ID NO: 9311 - protein, 238 aa, Shewanella pealeana ATCC 700345
MNSELKMNQELLLQVSHVSKRYQEGSVDTQVLHDVELQVFKGEQLAIVGSSGSGKSTLLHIMGTLDSPTSGSVTMLGEDLYKLSSQRQAQIRNENLGFIYQFHHLLPEFTALENVSMPALIQGKSRKQVEAKAKSLLERVGLAHRLSHTPAEMSGGERQRVAIARALINDPKLVLADEPTGNLDANSGEAVYELITELAAQLGTAFVVVTHDQSLAARMDRQLHMKDGHLVQAEELTA

SEQ ID NO: 9312 - protein, 231 aa, Shewanella baltica OS195; identical to SEQ ID NO: 9307

SEQ ID NO: 9313 - protein, 231 aa, Shewanella baltica OS223; identical to SEQ ID NO: 9307

SEQ ID NO: 9314 - protein, 235 aa, Dickeya zeae Ech1591
MSNSPLLQCRQLCKRYQEGNLSTDVLRDVSFDMQKGEMMAIVGSSGSGKSTLLHLLGGLDAPTSGEVVFQGKTLNQLSAAAKAALRNRELGFIYQFHHLLPDFSALENVAMPLLIGNVAPKEAKERAQTMLAAVGLAQRSQHRSSELSGGERQRVAIARALVNNPSLVLADEPTGNLDQRTTDAIFELLGELNVRQGTAFLVVTHDLRLAGRLGRQLEMRDGQLQQELTLMGASQ

SEQ ID NO: 9315 - protein, 235 aa, Pectobacterium carotovorum PC1
MSNLSLLQCNNLSKRYQDGKLSTDVLRDVSFEMSSGEMMAIVGSSGSGKSTLLHVLGGLDTPTSGEVIFKGQSLNTLSAAAKADLRNRELGFIYQFHHLLPDFTALENVAMPLLIGKVPTSQAQDKAREMLAAVGLEARSHHRSSELSGGERQRVAIARALVNSPSLVLADEPTGNLDQRTADTIFELLGELNVRQGTAFLVVTHDLQLASRLNRQLEMRDGQLQQELTLMGARQ

SEQ ID NO: 9316 - protein, 166 aa, Escherichia coli BL21 (DE3)
MTESTSRRPAYARLLDRAVRILAVRDHSEQELRRKLAAPIMGKNGPEEIDATAEDYERVIAWCHEHGYLDDSRFVARFIASRSRKGYGPARIRQELNQKGISREATEKAMRECDIDWCALARDQATRKYGEPLPTVFSEKVKIQRFLLYRGYLMEDIQEIWRNFAD

SEQ ID NO: 9317 - protein, 127 aa, Shewanella oneidensis
MLDDCEASGFINDKRYAELLVRSNIARGHGPIRIRQAIAQKGLTKDCIEAALIATDYDWFELAKAKAKAKAIKKYGVPKVTEVKGSQSRELIAKEKAKRVRFLLSQGFSYEQVIYALDYDPLEDNDD

SEQ ID NO: 9318 - protein, 159 aa, Geobacter sulfurreducens
MHSRPERRRDPLSTALDILSRRDHSEAELARKLRSRGIDAGEIDRIVARLREFGYLNDRRVACRLAESALAQGKMVGARLRVELRRRGIPPELAEEALAQAAAGCDERALVGDLLARKFPGFDPAVADPREKRRVVGWFQRRGFGLSAILEALRCPVDE

SEQ ID NO: 9319 - protein, 138 aa, Methylococcus capsulatus Bath
MARREHSRLELQRKLAARGFEFPTIAAVLAECSDRGWQSDARFAEGFVCARKAKGYGVNRIRQELRLRGVEADLADSRDWMTDMDRVYTKKYRGKLAVTTPRERASRARFLAQRGFTSSQIRDFFERLGVDGEYPDTD

SEQ ID NO: 9320 - protein, 150 aa, Nitrosococcus oceani ATCC 19707
MDDASLVEARNLLLGMLARREYSCWELQRKLTARGYSSSLIEKVLRELWQDNLQSDQRFAESYSRSRAERGFGPRRIAAELKQRGVSAVLITESLTQERDWDSQVMKARNKRFGQALPTNPKERARQMRFLQYRGFTQEQINHALSERDS

SEQ ID NO: 9321 - protein, 171 aa, Pelobacter carbinolicus
MTRRVKNRKKKIRTSCATMAPRTDAWSSALRLLSRREYSEAMLRERLQRKGFDSDQIEHALERCRSYNYVNDERFARIRARQLLASGRAVGPALMADLRHQRIGDSIARKAINDLEEEFSQAEILKDLCQRRFPDFDFQTADDRSRRRVFNYLRRRGFASAVLFQYFSEER

SEQ ID NO: 9322 - protein, 155 aa, Geobacter metallireducens GS-15
MGEERSGFSRALDILSRRDHSEAELALKLRRKGIDEREIASVVARLRELGYLNDRRLAERIAETAMAGGRMAGPRLSRELIRRGIPRELAAEALARATEGRDLRDDIREMLAGKFSSFDPREADLREKRRVVGWFQRRGYPLSAILDALRVSADE

SEQ ID NO: 9323 - protein, 158 aa, Thiomicrospira crunogena XCL-2
MESEQDKRQELAQQLESRAVYLLSMREHGRKELTNKLIQKIAGVEDYPGLVDFVLDKCVENNWLSDERYIETYVRQAMEKGQGPYKIRQTLRQRTHRDDLIDAYLAMDDSDWADLAKDALLKKYGEPVHSLERKEQARRMRFLQSRGFSQSQIWKAFN

SEQ ID NO: 9324 - protein, 155 aa, Methylobacillus flagellatus KT
MKKATNKPTTSLRERALAYLARREYSYQELLHKLSPHAGEEDNLPALLEDFKKRGWLSDTRYTEQIVHARKGRYGSLRVAHELRQHGISDELIGKAVAEMAPNELEAATAVYRKKFPQPPQSREEWAKQARFLQGRGFGFEVIRQVLRGSPEDIE

SEQ ID NO: 9325 - protein, 152 aa, Chromohalobacter salexigens DSM 3043
MSTQEATPRDDAIRLLARRDYSRSELMSRLAARGHAPDDIASLLDALADEGLQSDARFAEQFVRSRLSRGQGAMKIRAELGARGVTDEVAREALEGEAPDWHRLACEALAKRFDSPGRDPRERAKRERFLASRGFDFEQVRHAMAHAWENTR

SEQ ID NO: 9326 - protein, 155 aa, Pseudoalteromonas atlantica T6c
MNILPDMTDNDSKNIKYSITKYLSMREHSCHELLQKLTAKGYDKGLCEERIAQFNKADVQSELRYAEMIVRSRVAKGKGEKIIRSELSQHAIAPELIDIAITEQEIDWDALAIQVAEKKFGHKPAKDWQEQQKRNRFMQYRGFSHEQIRAMKSVR

SEQ ID NO: 9327 - protein, 152 aa, Shewanella sp. MR-7
MLLARRDYSRQEIRTKLLEKGFEVVDIDPVLDDCESSGFINDKRYAELLVRSHIARGHGPIRIRQAIAQKGLSKDCIEAALSANDHDWFELAKAKAIKKYAIPKVTEVKGSQSRELVAKEKAKRVRFLLSQGFNYEQVSYALDYDPLADNDD

SEQ ID NO: 9328 - protein, 123 aa, Shewanella sp. MR-4
MLDDCEASGFINDKRYAELLVRSHIARGHGPIRIRQAIAQKGLSKDCIEAALSVNDHDWFELAKAKAIKKYATPKVTAVKGSQSRELVAKEKAKRVRFLLSQGFNYEQVSYALDYDPLADNDD

SEQ ID NO: 9329 - protein, 152 aa, Alkalilimnicola ehrlichei MLHE-1
MEREAEVREQAIRLLARREHSVRELAFKLTRRGVPEELADAVIARLAQEGLQSDARYAESWVRHRVEQGYGPLRIRAELRERGVADAVAGPALAEVERQIDWADLARQVWARRFGTAPADLRERARQQRYLERRGFAAGHIRQVMSAAAQPD

SEQ ID NO: 9330 - protein, 150 aa, Magnetococcus MC-1
MTEIELYEQALRWLGRREYGEMELRNRLRTLPEVSLELVNKVVERLLAMDYLSDVRFAEALVRDRTRRGQGSLRIRHELQQKGVPALIIESSLAELAPNDTAQENAHRALVKRFGPTPPEDLKARKKRHDFLTRRGFDGQTIRMVLEALG

SEQ ID NO: 9331 - protein, 123 aa, Shewanella sp. ANA-3
MLDDCEASGFINDKRYAELLVRSHIARGHGPIRIRQAIAQKGLLKDCIEAALSANDHDWFELAKAKAIKKYAIPKVTEVKGSQSRELVAKEKAKRVRFLLSQGFNYEQVSYALDYDPMEDNDD

SEQ ID NO: 9332 - protein, 163 aa, Pelobacter propionicus DSM 2379
MTTRSRSKNTDPSSPEQGRQYALRLLAGRDYTVAALKQKLRARQLREEDLEQVVSRLEEEGWLSDRRFAERFSESALTSGRYVGVRLRQEMLRRGVPEELIDEQLARLCLDHDEDEQACQMLAKRFPAFTFAASGDHEKRRVAGFLQRRGFRFSTVMRAMRNA

SEQ ID NO: 9333 - protein, 145 aa, Shewanella amazonensis SB2B
MNHALASLARRDHSRNELKLKLLAKGHNALDIERVLDECEAKGYLNDSRYGASVVRSSVLKGHGAARARQAMIAKGLDKEVIQHNLEGCEVDWYAQARAKALKKFGATKPVDAKDRAKRIRYLAGQGFSFDEIAHALDFDPYDME

SEQ ID NO: 9334 - protein, 161 aa, Halorhodospira halophila SL1
MSEAGAASEAVRDAALRLLARREHTRRELAQKLARRGHDPGYVHPVLEALAEEGLLDEGRFAEVFVRSRVERGQGPVRIAQELRQRGVADGVIDEVLEDAEVDWLAQARAVRERRFGAGVPADRREALRQAQFLQRRGFTADQVRAAAAAADEDDERGPYG

SEQ ID NO: 9335 - protein, 137 aa, Shewanella baltica OS155
MLEKGFELNDIEPVLDACESSGFINDNRYAELLVRSHISRGHGAIRIRQAIAQKGLSKDCIEAAITNSDCDWFELAKDKATKKYGIPRVTEVKGSTARDLIAQEKAKRVRFLMGQGFSYDQITYALDSDPNDLDDDY

SEQ ID NO: 9336 - protein, 150 aa, Shewanella loihica PV-4
MTMSAMQVAVGLLARRDYSRYQIKSKLSQKGFLDGEIEAVLGQCESQGYLDDARFAGLLLRSHIAKGHGQNKIRQSMSQKGLTKEIIESSLNQSDCDWFELARQKAAKKYATSGPIQDQKERAKRVRYLLSQGFGFDQVAYALEVDPDFD

SEQ ID NO: 9337 - protein, 166 aa, Enterobacter sp. 638
MSESKPRRPAYARLLDRAVRILGVRDHSEQELRRKLAAPVIGKNGPEAIDATEEDYDRVIAWCYEHSYLDDTRFVTRFIASRSRKGYGPARIRQELNQKGIARDATEQAMRECDIDWGELARDQAVRKYGEPLPSEFSEKVKIQRFLLYRGYLMEDIQAIWRNFTD

SEQ ID NO: 9338 - protein, 137 aa, Shewanella putrefaciens CN-32
MLDKGFELNDIEPVLDACESSGFINDARYAELLVRSHISRGHGAIRIRQAIAQKGLSKDCIEAALVNCDCDWFELAKDKATKKYGIPRVTEVKGSKARDLIAKEKAKRVRFLMGQGFSYDQISYALDSDPNDLDEDD

SEQ ID NO: 9339 - protein, 152 aa, Vibrio cholerae O395
MSFDLATCRQSALQLLSRRDHSEYELHQKLALKGHPTEVIDEVVKYVLELGYLSDARYAASQARQIVHKGYGEQRLRQQLKEKRVAEEVIEQALAEQTIDWFELAKEVAHKKFKSGISHERSQYAKQVRYLQYRGFNFEQIRYALQASESDE

SEQ ID NO: 9340 - protein, 152 aa, Geobacter uraniumreducens Rf4
MEESGKALASALRTLTRRDHSEVELRRKLQDKGFAGGEVDAAIGKLKALGYLDDRRFAGQWAESAIRNGRGFGPRIRLELRRRGVSDSVIADVFARLAEDYGEEETLAALLARKFAGFKPNSADDREKRRVIGYLQRRGFSIAAILNVFREQ

SEQ ID NO: 9341 - protein, 137 aa, Shewanella baltica OS185
MLEKGFELNDIEPVLDACESSGFINDNRYAELLVRSHISRGHGAIRIRQAIAQKGLSKDCIEAAITNSDCDWFELAKDKATKKYGVPRVTEVKGSKARDLIAKEKAKRVRFLMGQGFSYDQITYALDSDPNDLDDDY

SEQ ID NO: 9342 - protein, 182 aa, Yersinia pseudotuberculosis IP 31758
MNDQLSRAMRLLSQRDHSESELRRKLAAPPFSAKGNWGKRSGAKSSNLVESNPVESNLAESNAIEESDPQVIEQVIDYCYQHNWLDDSRFAASYINSRSRKGYGVQRIRSELMQKGVDKERILAAFENSEIDWCQLAKEVAQRKFSETLPVEWKEKAKVQRYLLYRGFFQEEIQSIYTDSVE

SEQ ID NO: 9343 - protein, 155 aa, Vibrio harveyi ATCC BAA-1116
MYQKLQAPTLSSKEAAIQLLSRRDHGQYELYQKLALKGYEEADIEAAINFCLDHNYLDDLRYAKSQVRQHVYKGHGERRIRQELKQKRVAESIIDMAMAEEPQDWFELARMAAEKKFKGIKAKDQKEYAKQVRFLQYRGYSFDQISYALSFEDED

SEQ ID NO: 9344 - protein, 166 aa, Escherichia coli HS; identical to SEQ ID NO: 9316

SEQ ID NO: 9345 - protein, 168 aa, Serratia proteamaculans 568
MNDLLSRAMRLLSQRDHSEAELRRKLAAQPFMAKARFGTKTPSSSAPLPEEPVDPAVIEQVIAYCYQHNWLDDQRFARSYIGSRSRKGYGAQRIRSELMQKGVDKELTQAALADCEIDWCEQAKQVAQRKFGDQLPTDWKEKAKVQRYLLYRGFFQEEIQSIYRDFAQ

SEQ ID NO: 9346 - protein, 137 aa, Shewanella baltica OS195
MLEKGFELNDIEPVLDACESSGFINDNRYAELLVRSHISRGHGAIRIRQAIAQKGLSKDCIEAAITNSDCDWFELAKDKATKKYGIPRVTEVKGSKARDLIAKEKAKRVRFLMGQGFSYDQITYALDSDPNDLDDDY

SEQ ID NO: 9347 - protein, 144 aa, Coxiella burnetii RSA 331
MTDLRNRAISFLARREHSQEELKRKLVTRGYKLPEIETELASLAREGLQSDERYAEAYVRQRIESGFGRRRIIAELQQRGIENSLIQQYLPRDESFWFETLSSVWKNKYGYQSVKGKPSANQVRFLLQRGFDLEQIYKLFKKNE

SEQ ID NO: 9348 - protein, 166 aa, Escherichia coli C ATCC 8739; identical to SEQ ID NO: 9316

SEQ ID NO: 9349 - protein, 187 aa, Yersinia pseudotuberculosis YPIII
MNDQLSRAMRLLSQRDHSESELRRKLAAPPFSAKGNWGKRSGAKSSDVVESNLVESNPVESNLAESNAIEESDPQVIEQVIDYCYQHNWLDDSRFAASYINSRSRKGYGVQRIRSELMQKGVDKERILAAFENSEIDWCQLAKEVAQRKFSETLPVEWKEKAKVQRYLLYRGFFQEEIQSIYTDSVE

SEQ ID NO: 9350 - protein, 166 aa, Escherichia coli SMS 3 5
MTESTSLRPAYARLLDRAVRILAVRDHSEQELRRKLAAPIMGKNGPEEIDATAEDYERVIAWCHEHGYLDDSRFVARFIASRSRKGYGPARIRQELNQKGISREATEKAMRECDIDWCALARDQATRKYGEPLPTVFSEKVKIQRFLLYRGYLMEDIQDIWRNFAD

SEQ ID NO: 9351 - protein, 162 aa, Xanthomonas oryzae PXO99A
MNEQEPAPKRGRRFKEQTPVQRALGLLVRREHSRKELNRKLLARGIEPDAAQAAVDRLTGEGWQDDARFAAAVVRNRAGSGYGPLHIRAELGTHGLDSEAISAAMATFQGDWTENARDLIHRRFGEQGPIDLPQRRKAADWLARRGFDGNSIRAATRFDLED

SEQ ID NO: 9352 - protein, 166 aa, Shigella boydii CDC 3083 94
MTESTSRRPAYARLLDRAVHILAVRDHSEQELRRKLAAPIMGKNGPEEIDATAEDYERVIAWCHEHGYLDDSRFVARFIASRSRKGYGPARIRQELNQKGISREATEKAMRECDIDWCALARDQATRKYGEPLPTVFSEKVKIQRFLLYRGYLMEDIQDIWRNFAD

SEQ ID NO: 9353 - protein, 163 aa, Stenotrophomonas maltophilia R551 3
MSDAEDIPTGRKRRPREQTPVQRALGLLVRREHSRKELTRKLTARGIEDEAAQAAVAKLTEAGWQDDARFAENLVRMRANTGYGPIHVRAELGTHGLDSEAIAAAMDSYEGDWQENARDLVRRRFGETGPQDLAQRRKAADLLARRGFDGDSIRRATRYDPDD

SEQ ID NO: 9354 - protein, 166 aa, Salmonella enterica serovar Newport SL254
MSEPTSSRPAYARLLDRAVRILAVRDHSEQELRRKLSAPVMGKNGPEEIDATADDYERVIAWCHEHHYLDDERFVMRFIASRSRKGYGPARIRQELNQKGISRESTEKTMRECEIDWSEMAREQAVRKYGEPLPSNFSEKVKVQRFLLYRGYLMDDIQQIWRNFAD

SEQ ID NO: 9355 - protein, 166 aa, Salmonella enterica serovar Heidelberg SL476
MSEPTSRRPAYARLLDRAVRILAVRDHSEQELRRKLSAPVMGKNGPEEIDATADDYERVIAWCHEHHYLDDERFVMRFIASRSRKGYGPARICQELNQKGISRESTEKAMRECEIDWSEMAHEQAVRKYGEPLPSNFSEKVKVQRFLLYRGYLMDDIQQIWRNFAD

SEQ ID NO: 9356 - protein, 166 aa, Salmonella enterica serovar Schwarzengrund CVM19633
MSEPTSRRPAYARLLDRAVRILAVRDHSEQELRRKLSAPVMGKNGPEEIDATADDYERVIAWCHEHHYLDDERFVMRFIASRSRKGYGPARIRQELNQKGISRESTEKAMRECEIDWSEMAREQAIRKYGEPLPSNFSEKVKVQRFLLYRGYLMDDIQQIWRNFAD

SEQ ID NO: 9357 - protein, 153 aa, Alteromonas macleodii  Deep ecotype
MSDFDRKIITDAITRMLARREHSVNEIARKLQQKGIASEAFTPILDEFKDAGIQSDTRFAESRARALYMKGKGPRAIKLDLQQYGVDEGTAEQALNEIEADWFESARNVKVKKFGEFYETEFALRQKQKQFLQYRGFYQDHIDYAVSESSCEN

SEQ ID NO: 9358 - protein, 156 aa, Geobacter bemidjiensis Bem
MQRGSAFDCCLRVLALRDHAEAELRRKLERKGYQEEEVEASVVRLKELGYLDDLRFARAFAASQLRNGKGYGVRLKMELARRGVAAAIVDEVLSELAQEYGESDLLAQVMERRYASFDPTTATDKEKRKVIGYLQRKGFSLSAIFKKLDGHGCCDE

SEQ ID NO: 9359 - protein, 166 aa, Salmonella enterica serovar Agona SL483
MSEPTSRRPAYARLLDRAVRILAVRDHSEQELRRKLSAPVMGKNGPEEIDATADDYERVIAWCHEHHYLDDERFVMRFIASRSRKGYGPARIRQELNQKGISRESTEKAMRECEIDWSEMAREQAVRKYGEPLPSNFSEKVKVQRFLLYRGYLMDDIQQIWRNFAD

SEQ ID NO: 9360 - protein, 150 aa, Acidithiobacillus ferrooxidans ATCC 53993
MTTERSDPTALALRLLARREYGRRELGDKLLRAGCDAGDVALALDALAAAGYQDDARYVEMLTRTRVRQGHGPLRLRQDLQRAGIEVGADPEIDWLQQAQAVCRKRFGNTPPADARDYARRARFLAGRGFTGETIRQVLGAGRERDFAAD

SEQ ID NO: 9361 - protein, 166 aa, Salmonella enterica serovar Dublin CT 02021853; identical to SEQ ID NO: 9359

SEQ ID NO: 9362 - protein, 166 aa, Escherichia coli O157 H7 EC4115
MTESTSRRPAYARLLDRAVRILAVRDHSEQELRRKLAAPIMGKNGPEEIDATAEDYERVIAWCHEHGYLDDSRFVARFIASRSRKGYGPARIRQELNQKGISREATEKAMRECDIDWCALARDQATRKYGEPLPTVFSEKVKIQRFLLYRGYLMEDIQDIWRNFAD

SEQ ID NO: 9363 - protein, 163 aa, Shewanella baltica OS223
MSQSARQIAVALLARRDYSRLQIRDKLLEKGFELNDIEPVLDACESSGFINDNRYAELLVRSHISRGHGAIRIRQAIAQKGLSKDCIEAAIINSDCDWFELAKDKATKKYGVPRVTEVKGSKARELIAKEKAKRVRFLMGQGFSYDQITYALDSDPNDLDDDY

SEQ ID NO: 9364 - protein, 150 aa, Acidithiobacillus ferrooxidans ATCC 23270; identical to SEQ ID NO: 9360

SEQ ID NO: 9365 - protein, 156 aa, Thioalkalivibrio HL EbGR7
MRRNRRRPEDPAEPGDPYADGVRLLARREHSRSELRRKLAHKGHEPEALDEALDRLAAQRYQSDARFVETFVRHRVQQGYGPVRIAAELRERGIGESESEAGIAAAGADWQQLAEEALHRRFGDLPPEDAREWAKRARFLQYRGFSADLVRRALKR

SEQ ID NO: 9366 - protein, 162 aa, Dickeya dadantii Ech703
MTKLLRYAMNILAVRDHSEWELRRKIAAQLQNDLAIECCDEDAVPAHEGSYIEQVIDYCKQHAWLDDKAFASRYIRSRIRKGYGSQRICAELTQKGIDKHTQRDVLLASDIDWYQLAKASATRKFGIPLSSDWKEKVKVQRYLLYRGFTSDEIQSVYMNFSD

SEQ ID NO: 9367 - protein, 162 aa, Dickeya zeae Ech1591
MPNILRYVMNVLAVRDHSEMELRRKIAMYLQANPECDGADACSAPSEIHTQIEHAIASCKQQGWLDDGRYAQRYISSRCRKGYGFQRICVELSQRGIDKSIQRMALQSCDIDWYSQAKTVADRKFGSPLPTNWQERAKVQRYLLYRGFSHDEIQSVYMNFSD

SEQ ID NO: 9368 - protein, 164 aa, Pectobacterium carotovorum PC1
MNKPLRYAMNVLSVRDYSEAEIRRKCAAYLYKSESAEAEDEADEATTRSAAEDVDAAIAYCKEHGWLDDARYARRYINSRSRKGYGVQRIKMELSQKGIDKTILATALNESEIDWCALAKSVVERKFGHPLSDEWKDKVKHQRYLLYRGFFHEEIQSIYTNFSD

SEQ ID NO: 9369 - protein, 154 aa, Geobacter M21
MQRGSAFDCCLRILALRDHAEAELRRKLERKGYQEEEVEAGVARLKELGYLDDLRFARSFAASQLRNGKGYGVRLKMELSRRGVAAAIVDEVLGDLAKEYGESELLAQVMERRYGSFDPSTATDKEKRKVVGYLQRKGFSLGAIFKKLGARGRG

SEQ ID NO: 9370 - protein, 335 aa, Polaromonas JS666
MRRCLFAYKAKSQPMANPNTSSLDSRQLQTEDSDASPACVMTFNANDPSGAGGLTADIAAITSAGAHPLAVVTGAYVRDTAEIFDHFSFDEEAVTDQARSALEDMPVSAIKVGFVGSPENISTIAEIATDYADVPLIAYMPNLSWWDESEIDSYLDAFRELMLPQTTVLVGNHSSLWRWLLPDWPGERNPSARDIAKAAADLGVPYTLVTGIPLPDQFIDNVLATPQAVLYSEKFERFEAVFAGAGETLSAALSALLANGHDLQAATAEALTYLDHSLDAGFHPGMGNIVPDRLFWAQADVDDEESEDEAGDTPDDAALTSKPPFDLPPNGTTKH

SEQ ID NO: 9371 - protein, 318 aa, Acidovorax avenae citrulli AAC00-1
MTTDSPSKLTPPPSSGTDDDGGVPICVMAFNASDPSGAGGLTGDIATIASVGGHAVAVVTGAYVRDTAQVFDHYALDDEAVAEQARSVLEDLTVQAIKVGFVGSPENLSAIASIASDYDDVPVIAYMPNLSWWRDDLIDQYLDAFQELLLPQTSVLVGNYSTLSRWLLPDWSSDRKPSARDLAMAASELGVPYLLVTGIPAPEQHVENVLTSAQTVLGTTRFELFDATFTGAGDTLSAALAALVASGNDLAEAASEALTYLDRCLDAGFRPGMGHILPDRMFWAQPDDDDDDEDPDDGPGTDPTSTDGFVMPPHDTQH

SEQ ID NO: 9372 - protein, 314 aa, Acidovorax sp. JS42
MQSNTPSAPDSQSLTADDSESTAPTICVMVFNANDPSGAGGLAADISAVSSVGGHVAPVVTGTYVRDSAEIFDHYAFEDETVAEQARAVLEDMPLHAIKVGFVGSPENLSAISEIAADYADVPVIAFMPDLSWWQDDLIDQYHDAFRELLLPQTSVLVGNHSTLWRWLLPDWGSERPPSARDLAMAVAEIGVPYLLVTGIPAAERHIDNVLASPQTVLGSGRFERFEVTFIGAGDTLSATLAALIATGSDLGEATSEALTYLDGCLQHGFRPGMGHVLPDRMFWAQPDDEDTDDDVSPSAVVEGFDLPPHDTQH

SEQ ID NO: 9373 - protein, 324 aa, Polaromonas naphthalenivorans CJ2
MANPHTPQLDSRQLQIEDSDASPACVMTFNANDPSGAGGLTADITAITSAGAHPLSVVTGTYLRDTAEIFDHISFDDDAVTEQARAALEDMPVSAIKVGFVGSPENISTIAEIASDYSDVPLVAYMPSLSWWDETEIDSYLDAFRELMLPQVTLLIGNHSTLWRWLLPDWSTERNPSARDIAKAAAALGVPYTLVTGIPLPDQFIDNVLATPQAVLYSEKFERFEAVFEGAGETLSAALCALLANGHDLQAATAEALTYLDHSLDAGFHPGMGHIVPDRLFWAQAEDDEASDDEAADAELSGNDDAGLTSKPPFEFPPNGTTKH

SEQ ID NO: 9374 - protein, 320 aa, Verminephrobacter eiseniae EF01-2
MTSPPFPPAPDRRAPDDDERQGAGPACVLVFNASDPSGAGGLTADITAIASVGGHPIAVVTGAYARDTAEIFDHFSFDDEVVAEQARTVLEDLAVQAIKVGFVGSPENISAIARITTDYDEVPVIAYMPNLSWWRDELIDEYLNAFRELLLPQASVLVGNHSTLWRWLLPDWSGQRSPTARDIARAAAEMGVPYTLVTGIALPEQFVENMLASPQVLLGGGKFELFDASFCGAGDTLSAALTALVACGNDLGEATGEALGYLDRCLDAGFRPGMGHILPDRMFWAAPGADDARDAEEDNPTIDDAQALEGFVMPPHDTKH

SEQ ID NO: 9375 - protein, 319 aa, Methylibium petroleiphilum PM1
MNTIAPSATEPTEPAASDAPPACVMSFNASDPSGAGGLAGDISTIAAMGAHALPVVTAIVMRDTAEVFESHEIEADTIVEQARSILEDVTISAWKVGFLGSAEGVAGVAEVLSDYPDVPLVAYLTSVSWLEEDDQQAYQDAYRELILPATEVLVGNQQTLVDFLLPEWEAERPPSARELAVAAGELGARYVLVTGIALPASRGAEAQVDNVLASPQGAITGEKFERFDATFLGAGETLAAALASLLASGQDLHLAVSEALSFLDQALDAGFRPGMGNVVPDRFFWALPEAEPGAEEEGLMGEPATDELPSAERGPRRIH

SEQ ID NO: 9376 - protein, 318 aa, Delftia acidovorans SPH-1
MALNPSNSPSPDTELVDETAPVCVLVFNASDPSGAGGLSADIATIASVGGHPLPVVTGAYARDSAKIFEHFPFDDEAVAEQARAVLEDIPVSAIKVGFVGSPGNLAAIAEIASDYPDIPIVCYMPDLSWWEEDPLDQYMDALKELVLPQTSVLVGSHSTLCRWLLPDWSNSRSPTARDIAMAAEALEVPYVLVTGIPLPDQFVDNVLATAQSVLGNSKYEMFDATFTGSGDTLSAALAALVASGNDLGLATQEALEYLDRSLDSGFRPGMGHFIPDRMFWAQPEPEDEDAEAAEPLTELDADTQAIEGFVMPPHDTKH

SEQ ID NO: 9377 - protein, 310 aa, Leptothrix cholodnii SP 6
MNPTATDTPTESPEDLAPGPVCVMCFNASDTTGAGGVPGDVATVAAMGGHAVPVITTIVMRDTAEVFDQSPIDPDTVVEQARSVLEDLTISAWKVGFLGTAETVGAVAEVLTDYPDVPLVTYVPNLSWIDDEDAAQSYHDALRELVLPQTEVLVGTQKTLTDFLLPEWDAERPPSARELAVAAAEHGTSYVLVTGVQLPNNFIDNVLASPQGAITGEKYERFDAAFVGAGDTLSAALATLLASGQELHIAVSEGLAFLDQALDAGFRPGMGNVIPDRFFWAVPPDEEDEEALDGEDTPDANSPPTSRNIH

SEQ ID NO: 9378 - protein, 314 aa, Diaphorobacter TPSY uid29975
MQSNTPSAPDSPSLTADDSESTAPTICVMVFNANDPSGAGGLAADISAVSSVGGHVAPVVTGTYVRDSAEIFDHYAFEDETVAEQARAVLEDMPLHAIKVGFVGSPENLSAISEIAADYADVPVIAFMPDLSWWQDDLIDQYHDAFRELLLPQTSVLVGNHSTLWRWLLPDWGSERPPSARDLAMAVAEIGVPYLLVTGIPAAERHIDNVLASPQTVLGSGRFERFEVTFIGAGDTLSATLAALIATGSDLGEATSEALTYLDGCLQHGFRPGMGHVLPDRMFWAQPDDEDTDDDVSPSAVVEGFDLPPHDTQH

SEQ ID NO: 9379 - protein, 321 aa, Variovorax paradoxus S110
MTIYLHPADHARKPGNLNDPSPDAEEVAERDLNPPCVLVFNASDPSGAGGLGADALAMASVGAHMLPVVTGAYARDTAEIFDHFAFEEEAIAEQARAILEDVEVQLIKVGFVGTPDALSTIAETASDYPEVPLVAYMPNLSWWDEDLIEGYLDAFRELLLPQATVLVGNHSTLWRWLLPDWSGERPPGARDIAKAAGEFGVPYTLVTGMVLPDQFIDNVLASPQSVLASEKYERLEAVFAGAGDTLSAALAALLASGTDLVAATTEALAYMDRCLDAGFRPGMGHVLPDRLFWAEPEDDDDDDEDPDAPQDFALPPHDTRH

SEQ ID NO: 9380 - protein, 122 aa, Ralstonia solanacearum
MAIKKILVVDDSPTEALFLSEILSKNGFKVSVAADSDQAMAKLEGEPFDLVLMDVVMPGQNGYQATRAIKKDDRFKDIPVIICTTKGLETDRVWGMRQGASDYIVKPVKAEELLEKIAKLPQ

SEQ ID NO: 9381 - protein, 121 aa, Pseudomonas putida KT2440
MARVLIVDDSPTEMYRLTEWLEKHGYQVLKASNGADGVALARQDKPDAVLMDIVMPGMNGFQATRQLSKDPDTSAIPVIVVTTKDQETDRIWATRQGARDFLTKPVEEEALIAKLKEVLGA

SEQ ID NO: 9382 - protein, 121 aa, Pseudomonas syringae tomato DC3000
MARILIVDDSPTEMYKLTGMLEKHGHEVLKAENGADGVALARQEKPDAVLMDIVMPGLNGFQATRQLTKDADTSNIPVIMITTKDQETDKVWGKRQGARDYLTKPVDEETLMKTLNAVLAG

SEQ ID NO: 9383 - protein, 121 aa, Pseudomonas syringae pv B728a
MARILIVDDSPTEMYKLTGMLEKHGHEVLKAENGADGVALARQEKPDAVLMDIVMPGLNGFQATRQLTKDPDTTNIPVIMITTKDQDTDKVWGKRQGARDYLTKPVDEETLMKTLNAVLAG

SEQ ID NO: 9384 - protein, 120 aa, Psychrobacter arcticum 273-4
MITVLVIEDSLSEMAKFRDMLSKNNYQVLEATNGKQGCQMAIAHLPDVILMDVVMPEMNGFQATRKITRDEVTAHIPIIMISTKNQETDRVWGKRQGAKEYLTKPVNESDLVQTICKVME

SEQ ID NO: 9385 - protein, 121 aa, Dechloromonas aromatica RCB
MPVKNILVVDDSPTERFFTVDVLTKAGYQVSTAETGEEGIAKAKATKPDLILMDVVMPGLNGYQATRTLTRDEETKGIPIIVCTSKGQETDKIWGLRQGAIDYLVKPLNPEELLQRIAALP

SEQ ID NO: 9386 - protein, 123 aa, Ralstonia eutropha JMP134
MTTINKILIVDDSPTEALFMSDLLGKQGFKVSVAGNSDQAFARLEAEAFDLILMDVVMPGQNGYQATRAIKRDDRFKDIPVIMCTSKGLDTDRIWGMRQGASDYIVKPVDSKELLTKIAALSH

SEQ ID NO: 9387 - protein, 121 aa, Thiobacillus denitrificans ATCC 25259
MAISRILVVDDSPTERFFLSELLVKNGYLVSMAESGEEAVAQAKQTLPDLIVMDVVMPGMNGYQATRMISKEEATKHIPVIMCTTKGQETDKVWGMRQGAKAYLVKPVKPEDLLSQIKALG

SEQ ID NO: 9388 - protein, 121 aa, Nitrosococcus oceani ATCC 19707
MTHILVVDDSSTESHAFRIMLEKKGFTVSFANNGLEGLTKAKALKPDLILMDVVMPQVNGFQATRKLKRDPETAGIPVIIISAKNQETDRVWGLRQGAKGYLSKPVSKEELFNKINMLINP

SEQ ID NO: 9389 - protein, 121 aa, Rhodoferax ferrireducens T118
MAIHKVLIVDDSKTELMFMTNLLQKNGMSVRTAEGADEALRRLAEEKPDLILMDVVMPGQNGFQLTRSINRTPEYSDIPIIMCTSKSLETDRVWGMRQGARDYITKPVDAAELLVKIKALG

SEQ ID NO: 9390 - protein, 120 aa, Saccharophagus degradans 2-40
MAKVLIVDDSPTETYKLTTILEKNGHTVITAGNGEEGVVTAKAEIPDLVLMDIVMPGLNGFQAARQLSKAPETAHIPVIIVTTKDQETDRVWGMRQGAKAYLTKPIDEKDLLSTISKVGV

SEQ ID NO: 9391 - protein, 121 aa, Methylobacillus flagellatus KT
MTIKKILVVDDSATDRLYLSELLQKAGFEVSTAEDGQDCLEKVSASMPDLVLMDVVMPRLNGFQATRSLSRNPDTAHIPVIVCTGKEQATDRMWALRQGARDCVIKPVDADELLSKIAEIC

SEQ ID NO: 9392 - protein, 121 aa, Polaromonas JS666
MAIKKILVVDDSKTELMFLTDLLVKNGFTVKTAENAEDAFRRLAEDKPELILMDVVMPGQNGFQLTRAITRDPLYSDIPIMMCTSKNQETDRVWGMRQGARDYITKPVDADELMAKIKALG

SEQ ID NO: 9393 - protein, 120 aa, Psychrobacter cryohalolentis K5
MTTVLVIDDSPSEMAKFRDMLSKNNYQVLEATNGEQGCQMAIAHLPDVILMDVVMPEMNGFQATRKITRDKATAHIPIIMISTKNQETDRVWGKRQGAKEYLTKPIDESGLVQIIRKVME

SEQ ID NO: 9394 - protein, 122 aa, Cupriavidus metallidurans CH34 uid250
MTISKILIVDDSPTEALFMSDLLGKKGFKVSVAGNSDQAMARLEADAFDLILMDVVMPGQNGYQATRAIKRDDRFKDIPVIMCTSKGLETDRIWGMRQGASDYVVKPVDSEELLSKIAALAN

SEQ ID NO: 9395 - protein, 121 aa, Alkalilimnicola ehrlichei MLHE-1
MARILVIDDSPTDLHAIRSILEGEGHQLIEAGDGEQGLEQARSAHPDLILMDIVMPGMNGFQATRRLNRDAETASIPVIMVSSKDQATDRIWAKRQGAVDYIAKPVERDELLQKVRAVLGG

SEQ ID NO: 9396 - protein, 121 aa, Pseudomonas aeruginosa UCBPP-PA14
MARILIVDDSPTEMYKLTAMLEKHGHQVLKAENGGDGVALARQEKPDVVLMDIVMPGLNGFQATRQLTKDAETSAIPVIIVTTKDQETDKVWGKRQGARDYLTKPVDEETLLKTINAVLAG

SEQ ID NO: 9397 - protein, 121 aa, Acidovorax avenae citrulli AAC00-1
MPIQKVLVVDDSKTELMFLTDLLQKKGMQVRTAENADEAFRRLAEEKPDLILMDVVMPGQNGFQLTRAISRDPQYADVPIIMCTSKNQETDRVWGMRQGARGYITKPVDPAELQAKIDALN

SEQ ID NO: 9398 - protein, 121 aa, Acidovorax sp. JS42
MPIQKVLVVDDSKTELMFLTDLLQKKGMQVRTAENAEEAFRRLAEEKPDLILMDVVMPGQNGFQLTRAITRDPQYADVPIIMCTSKNQETDRVWGMRQGARGYITKPVDPAELQAKIDALN

SEQ ID NO: 9399 - protein, 121 aa, Polaromonas naphthalenivorans CJ2
MSIKKVLVVDDSKTELMFLTDLLVKNGFSVKTAENAEDAFRRLAEEKPELILMDVVMPGQNGFQLTRAIARDPLYADIPIMMCTSKNQETDRVWGMRQGARDYITKPVNAGELMAKIKALS

SEQ ID NO: 9400 - protein, 121 aa, Verminephrobacter eiseniae EF01-2
MPIQKVLVVDDSKTELMFLTDLLQKKGIQVRTAENAEEAFRRLAEEKPDLILMDVVMPGQNGFQLTRAITRDPQYADVPIIMCTSKNQETDRVWGMRQGARGYITKPVDPAELQAKIDALG

SEQ ID NO: 9401 - protein, 121 aa, Methylibium petroleiphilum PM1
MTIAKILLVDDSKTELHFLSELLVKRGYQVRTAENGEEAMRRLGEEKPDLILMDVVMPGQNGFQLTRAITRDVRFTDVPVIMCTSKNQETDKVWGMRQGARDYVVKPVDADELIAKIRAFD

SEQ ID NO: 9402 - protein, 120 aa, Marinobacter aquaeolei VT8
MARILIVDDSPTEVKKISTILEKHKHEVLTADNGADGVAKARAETPDLVLMDVVMPGLNGFQATRQLTRAPETASIPVVIVTTKDQETDRVWGTRQGAKGYLVKPVNEDDLIKTINSLIA

SEQ ID NO: 9403 - protein, 121 aa, Pseudomonas mendocina ymp
MARILIVDDSPTEMYKLTAMLEKHGHQVLKAENGADGVALARQEKPDAVLMDIVMPGLNGFQATRQLTKDAETSHIPVIIVTTKDQETDKVWGKRQGAKDYLTKPIDEDTLLKTLNAVLAG

SEQ ID NO: 9404 - protein, 121 aa, Pseudomonas putida F1; identical to SEQ ID NO: 9381

SEQ ID NO: 9405 - protein, 120 aa, Psychrobacter PRwf-1
MHKVLVVEDSQSEMARFRELLIKNNYEVIEASDGQQGVEMAQMHLPDAILMDIVMPEMNGFQATRKITRNEATGHIPVVMISTKNQETDRIWGKRQGAKAYLTKPVNETELLTTIDSVIG

SEQ ID NO: 9406 - protein, 121 aa, Pseudomonas aeruginosa PA7; identical to SEQ ID NO: 9396

SEQ ID NO: 9407 - protein, 121 aa, Delftia acidovorans SPH-1
MPIRKVLVVDDSKTELMFLSDMLQKQGLQVRTAENGEEALRSLAEERPDLILMDVVMPGQNGFQLTRAITRDPLYADLPIIMCTSKNQETDRVWGMRQGARDYITKPVDAGELQAKIAALN

SEQ ID NO: 9408 - protein, 121 aa, Pseudomonas putida GB 1
MARVLIVDDSPTEMYRLTEWLEKHGYQVLKASNGADGVALARQDKPDAVLMDIVMPGMNGFQATRQLSKDPETSAIPVIVVTTKDQETDRIWATRQGARDFLTKPVEEDALIAKLKEVLGA

SEQ ID NO: 9409 - protein, 121 aa, Pseudomonas putida W619
MARVLIVDDSPTEMYRLTEWLEKHGHQVLKANNGADAVALARQEKPDAVLMDIVMPGMNGFQATRQLSKDPETSAIPVLIVTTKDQETDRIWAQRQGARGFVTKPVEEHALIAKLNEVLGA

SEQ ID NO: 9410 - protein, 121 aa, Leptothrix cholodnii SP 6
MAIHNILLVDDSKTELYFLSDLLSRQGFKVRTAENGDEALRRIAEEKPDLILMDVVMPGLNGFQLTRTITRDPQYADVPVIMCTSKNQETDKVWGMRQGARDYVVKPVNPDELMQKIRAFG

SEQ ID NO: 9411 - protein, 120 aa, Xanthomonas oryzae PXO99A
MARIVLIEDSPTDSAVFSQWLEKAGHTVVATDNAEEGLELVRSQVPDLVLMDVVLPGMSGFQATRALARDQATKDIPVLLVSTKGMETDRAWGLRQGASDYIVKPPREDDLIARIRQLVR

SEQ ID NO: 9412 - protein, 122 aa, Ralstonia pickettii 12J
MAIKKVLVVDDSPTEALHLSEILGKNGFKVTVAADSEQAMTKLEAETFDLILMDVVMPGQNGYQATRAIKKDERFQGIPVIMCTTKGLETDRVWGMRQGASDYIVKPVKAEELLEKIAKLAQ

SEQ ID NO: 9413 - protein, 120 aa, Stenotrophomonas maltophilia R551 3
MARIVLIEDSPTDRAVFTQWLRRAGHEVLEADNAEDGLQLVRDQSPQLVLMDVVLPGMSGFQATRAMARDAAIKHIPVIIVSTKAMETDKAWGLRQGAADYIVKPPREDELIARINELVA

SEQ ID NO: 9414 - protein, 121 aa, Thauera sp. MZ1T
MPIRKILVVDDSPVERLALQEVLGRNGYQVLTAENGEQAIARSRSDHPDLILMDVVMPGMNGYQATRTISRDDETRDIPIIMCTSKGQETDKIWGMRQGALDYLVKPVDHDELLARIRAMG

SEQ ID NO: 9415 - protein, 120 aa, Thioalkalivibrio HL EbGR7
MTQILVVDDSPTEIHVLKTILEKNGYSVMTASSGEEGVAMAKQHKPALVLMDVVMPGLNGFQATRQLANDAATSSIPVIVVTTKDQETDKVWAMRRGAKDYIVKPVKERDLLERVKALVA

SEQ ID NO: 9416 - protein, 121 aa, Diaphorobacter TPSY uid29975; identical to SEQ ID NO: 9398

SEQ ID NO: 9417 - protein, 121 aa, Variovorax paradoxus S110
MPIRKILVVDDSKTELVFLSDLLQKNGFAVKTAENAEDAMRRLEEDQPDLILMDVVMPGQNGFQLTRAIARDPQYAAIPIILCTSKNQETDRVWGMRQGARDYIVKPVNAAELMSKISALA

SEQ ID NO: 9418 - protein, 122 aa, Ralstonia pickettii 12D; identical to SEQ ID NO: 9412

SEQ ID NO: 9419 - protein, 151 aa, Jannaschia CCS1
MADTEYSFAEIATGGVVFAAAIGFFDYASGSGAATSAERYELQATFQSAEGIGIGTEVRLGGVQIGTVTGMALNPETFLAETTFSVSNAIALPDDTAISIASESLLGGSYVEIIPGTSPFNLEAGGEILDTQSSVGLATLLLRFVSGAADN

SEQ ID NO: 9420 - protein, 150 aa, Ruegeria sp. TM1040
MTHSTTEVLTGGLVLAVAAGFAFYAAQAAGLSRGGDSYPLTASFRSLEGVSVGTDVRLAGVKIGTVTDVALNAETFRADTTFSVDKSIMIPDDSAIVIASEGLLGGNFVEVMPGGSPFNLEAGDEIVDTQGAVSLISLLVKFVSGGGDES

SEQ ID NO: 9421 - protein, 151 aa, Rhodospirillum rubrum ATCC 11170
MRNPIETIMGAVVLVVAAFFLVFAYNTADLKAVTGYPIQAVFLKVGGLVTGSDVRINGVKVGTVTGQTLDSDTYEAVVDMTISGDIHIPEDSRAAIVSDGLLGGKYVRLEPGQSATRLAANARLTHTQDFQSMEELVGEIIFLATQPAPGS

SEQ ID NO: 9422 - protein, 156 aa, Rhodobacter sphaeroides 2 4 1
MAENRSELLAGAAVLAAAIGFIVYAGQVAGITRDSGSYPLKASFRSVDGISVGTDVRLAGVKVGSVTGLALNPQTYFADATISVKQGIELPTDSAILISSEGLLGGNYVELVPGGALETLAAGEEIEDTQGSVSLISLLMKFVGSGAEDTVKGPGE

SEQ ID NO: 9423 - protein, 155 aa, Paracoccus denitrificans PD1222
MNSAAERAELWVGAAVLAVAAGFLVWSTTGSRLGVSLAGGYELRAAFPNVDGIEVGTDVRVAGVRVGRVSAVDLNPQTYHAEARLRLPDSIRLPSDSAALIQSDGLLGGAYIELQPGGAPDNLAPGDEIEDVQGAVSLISLMMKFVDAQSTDDSP

SEQ ID NO: 9424 - protein, 156 aa, Rhodobacter sphaeroides ATCC 17029
MAENRSELLAGAAVLAAAIGFVVYAGQVAGITRDSGSYPLKASFRSVDGISVGTDVRLAGVKVGSVTGLALNPQTYFADATISVKQGIELPTDSAILISSEGLLGGNYVELVPGGALETLAAGEEIEDTQGAVSLISLLMKFVGSGAEDTVKGPGE

SEQ ID NO: 9425 - protein, 156 aa, Rhodobacter sphaeroides ATCC 17025
MAENRSEILAGAAVLAAAIGFLVYAGQTAGITRDSGSYPLTASFRSAEGISVGTDVRLAGVKVGTVTALALNPQTFFADATISVKQGIELPTDSAILISSEGLLGGNYVELMPGGALENLAPGEEIEDTQGSVSLISLLMKFVGSGAESAIQGEEG

SEQ ID NO: 9426 - protein, 166 aa, Acidiphilium cryptum JF-5
MKNRVSEIIAGLVVIVAAAVFLAYAASRTRTVGGTGYDLRASFGSIGPLTVGSPVKIAGVTIGEVTRTSLDPQTYAAIVQFRIQPDVKIPKDSSAAIESASLLGSDYLSISPGGSETMLKPGQAITATQSAINIESLLGKFVFSAANLATSTAKANGGGTSAPAPK

SEQ ID NO: 9427 - protein, 164 aa, Sphingomonas wittichii RW1
MKSLLRENIGEALVGLFVVLFAAWFVWFAWGATGGGAKAGAIHVTALFPNSTGINVGSEVRVAGMKIGTVTSQALDPQSFQVKTTLALDPKVKLPADSSAAITSEGFLGATFVSLIPGGDTVPLKDGDTIADTQGAMDLMSMVGQFINKSGGAAAGGAEEAPKP

SEQ ID NO: 9428 - protein, 164 aa, Parvibaculum lavamentivorans DS-1
MQSNLVETLIGTLVVAVAAVFLFYGYSASGMRGSAGYHVNAAFSGIDGLANGADVRVSGIKVGTVVRQNLDPETFQAVVTLDIAQNVKLPDDSSAKITSEGLLGGSYISVTPGGSEEYLADGGEIMFTQGSVDLMSLIGQAVFSTQGGGDSSGGSPAADPMGGQ

SEQ ID NO: 9429 - protein, 148 aa, Dinoroseobacter shibae DFL 12
MSHSKTEVVVGGAVLAAAVGFLLFVSNATGFSGGGSGYPLTASFRSADGITIGTDVRLAGVKIGTVTGIALNPETFRADTTISVSENIEIPDDSAISVSSEGLLGGNFIEILPGGSPFAMETGGEFIDTQGSVSLVSLLMKFVGGDGS

SEQ ID NO: 9430 - protein, 87 aa, Ralstonia solanacearum
MKRMIPLLLVAALAACGPSETPRQANVPTVEELAADPARLKELRQQCKTDRATLGDVLCNRVAEATRKRFYGDGKTPYTPSETPPKF

SEQ ID NO: 9431 - protein, 104 aa, Burkholderia thailandensis E264
MNHLRQRRPSYHLIPTRGRNSAVKPIMLILLVALLTACGKSKPTETVDSLVANPEHLKELRQQCKKDRVTLGDELCNRVAEATNRQFLGNGKAPYTPPKDAPKF

SEQ ID NO: 9432 - protein, 92 aa, Cupriavidus metallidurans CH34 uid250
MKKIIPFLLVAALTACGQSETPLNATNSKARIPTVEELAANPEHLKELRLQCKTDRPKLGDTICDRVAEATRKRFYGDRDTPYTPPKQSPKF

SEQ ID NO: 9433 - protein, 92 aa, Cupriavidus metallidurans CH34 uid250
MKKIVPLLLGVALTACGQSEVPQKANTSEADIATVEELAANPERLKELRQQCKTDRPKVGDVLCNRVAEATRKRFYGDGETPYTPPKESPKF

SEQ ID NO: 9434 - protein, 88 aa, Burkholderia ambifaria AMMD
MMRNSIPFLLAVALTACGQSETPKQAEVSTVEELAADPALLKELRQQCKTDRARLGDVLCNRVAEATRKRFYGDGKTPYTPPKEQPKF

SEQ ID NO: 9435 - protein, 87 aa, Shewanella sp. ANA-3
MKQIVPLLLVATLAGCGQSDSPRQADVLTVEELAADPARLKELRQQCKTERAQLGDVLCNRVAEATNQRFFGEGGTPYTPPEESPRF

SEQ ID NO: 9436 - protein, 88 aa, Acidovorax avenae citrulli AAC00-1
MKRSIPLLLVAALAACGPSEPPKEQANVPTVEELAAAPERLKELRRQCKTERPTMGDVLCNRVAEATNKRFFGDGKVPYTLSETPPKF

SEQ ID NO: 9437 - protein, 80 aa, Polaromonas naphthalenivorans CJ2
MKMIAALMLVLQLTACGQSAPTETVESLAANPERLKELRAQCKADRAKLGDALCNAVAEATHKRFIGNGTPYTPEPTPKN

SEQ ID NO: 9438 - protein, 87 aa, Pseudomonas aeruginosa PA7
MNKITPFLLTVVLAACGQSETPTSAAVPTVEELATNLERLKELRQQCKLDRAKLGDELCNRVAEATRKRFYGNGTVPYTPPETPPKF

SEQ ID NO: 9439 - protein, 92 aa, Pseudomonas aeruginosa PA7
MKRIIPLLLFAAMTACGQSEAPQKANISEANIPTVEELAANPERLKELRQQCKTDRPRLGDVLCNRVAEATRKRFYGDGATPYNPPKEPPKF

SEQ ID NO: 9440 - protein, 72 aa, Delftia acidovorans SPH-1
MILLILVTALPACGPSQPSETVDALVANPERIKEIQRQCKEDRAKVGDELCLRAAEAAKRRFFGDRPEQKSK

SEQ ID NO: 9441 - protein, 88 aa, Burkholderia multivorans ATCC 17616 JGI
MMKNSIPFLLAVALTACGQSEMPKQADVPTVEELAADPARLKELREQCKTDRARLGDVLCNRVAEATRKRFYGDGNTPYTPPKEPPKF

SEQ ID NO: 9442 - protein, 76 aa, Ralstonia pickettii 12J
MPRFLSLLMAAALTASCGPSQPTETVDFLVAHPERLKEVQRLCKEERAKAGEELCRRAAEAANRRFFGDRPEQKSQ

SEQ ID NO: 9443 - protein, 87 aa, Thauera sp. MZ1T
MKKAIPFLLAVVLTGCGQSEVPQKADLPTVEALASNPERLKELRQQCKLERARLGDELCNRVAEATRKRFYGDGKVPYTPPENQPKF

SEQ ID NO: 9444 - protein, 92 aa, Thioalkalivibrio HL EbGR7
MNKIIPFLLVVAMTGCGQSETPQKAKGSDAGVPTVEELAANPERLKELRQQCKTDRPKLGDVLCNRVAEATRKRFYGDGETPYTPPKESPKF

SEQ ID NO: 9445 - protein, 75 aa, Diaphorobacter TPSY uid29975
MSKVMLLMLAATLTACGPSQPSETVDALAANPERIKEIQQLCKEDRAKVDDELCRRAAEAAKRRFYGDRPEQKSR

SEQ ID NO: 9446 - protein, 75 aa, Diaphorobacter TPSY uid29975
MNRVMLLMLTTALTACGPSQPSETVDYLVAHPDRIKELQRQCKEDRAKVGDELCVRAAEAANRRFFGDRPEQKSK

SEQ ID NO: 9447 - protein, 88 aa, Azotobacter vinelandii DJ
MKKTIPFLLAAVVLTACGPTDTPEKTDVPSVEELASDPVRLKELRQQCKTDRLKLGDVLCNRVAEATRKRFYGDGNTPYTPPENPPKF

SEQ ID NO: 9448 - protein, 87 aa, Azotobacter vinelandii DJ
MKKAIAFVLVAVLTGCGPKDAPEKKDVPSVEELASDPARLKELRQQCKTERPRLGDVFCNRVAEATRKRFYGDGNTPYTPPEEPPKF

SEQ ID NO: 9449 - protein, 131 aa, Clostridium perfringens SM101 uid12521
MRKTSLLNSNISSVISKMGHTDMLAIGDCGLPIPKETERIDLALIKGVPGFIETLKAILEELQVEEVLIAKETEKVSPELFTKIKEIIKDTKITFISHEELKKELKDCKAVVRTGEQTPYANIILKSGVVF

SEQ ID NO: 9450 - protein, 139 aa, Enterobacter sp. 638
MKKGTVLNSEISSVISRLGHTDTLVVCDAGLPVPHSTTRIDMALTQGVPSFMQVLDVVTAEMQVETAILATEIKQHNPQLHETLLGHIEQLQQHQGNTIEIRYTTHEQFKQQTADSQAVIRSGECSPYANIILCAGVTF

SEQ ID NO: 9451 - protein, 139 aa, Vibrio cholerae O395
MKKSTLLNSELSYLVATLGHTDEITICDAGLPIPDEVTRIDLALTHGVPSFLETVRVILSESQIESVIVAQEFAQVSPVLHEALYRELKAEEQLCGKPIAIQYISHEAFKQRTLQSRAVVRTGECTPYANVIFQAGVVF

SEQ ID NO: 9452 - protein, 139 aa, Escherichia coli HS
MKKGTVLNSDISSVISRLGHTDTLVVCDAGLPIPKSTTRIDMALTQGVPSFMQVLGVVTNEMQVEAAIIAEEIKQHNPQLHETLLTHLEQLQKHQGNTIEIRYTTHEQFKQQTAESQAVIRSGECSPYANIILCAGVTF

SEQ ID NO: 9453 - protein, 139 aa, Escherichia coli E24377A
MKKGTVLNSDISSMISRLGHTDTLVVCDAGLPIPKSTTRIDMALTQGVPSFMQVLGVVTNEMQVEAAIIAEEIKQHNPQLHETLLTHLEQLQKHQGNTIEIRYTTHEQFKQQTAESQAVIRSGECSPYANIILCAGVTF

SEQ ID NO: 9454 - protein, 139 aa, Serratia proteamaculans 568
MKKGVLLNADVSAVVSRLGHTDQIVICDAGLPIPAATQRIDLALTQGVPTFLQVLGVVTQEMQVESAILAEEIVKQNPQLHRALLAQLTELGQHQGNTISVSYISHSAFKAQTEHSRAVIRSGECSPYANVILCAGVTF

SEQ ID NO: 9455 - protein, 139 aa, Escherichia coli C ATCC 8739; identical to SEQ ID NO: 9452

SEQ ID NO: 9456 - protein, 143 aa, Escherichia coli SMS 3 5
MEKKMKKGTVLNSDISSVISRLGHTDTLVVCDAGLPIPKSTTRIDMALTQGVPSFMQVLGVVTNEMQVEAAIIAEEIKQHNPQLHETLLTHLEQLQKHQGNTIEIRYTTHEQFKQQTAESQAVIRSGECSPYANIILCAGVTF

SEQ ID NO: 9457 - protein, 135 aa, Natranaerobius thermophilus JW NM WN LF
MKKTTLLNSEISRVTSQMGHTDGLTISDAGPPIPQESERIDLALKEGVPAFMETLETVLSELQVEAVVLTTETREVSPQTYHKIVDLLKQYNPDIQITEIDHESFKKEVSNTKAVVRTGECTPFSNIILKSGVVF

SEQ ID NO: 9458 - protein, 139 aa, Salmonella enterica serovar Newport SL254
MKKGTVLNSEISSVISRLGHTDTLVVCDAGLPIPNSTARIDMALTQGVPSFMQVVDVVTREMQVEAAILATEIKQQNPQLHETLLTHLEQLQQHQGNTIKISYTTHEQFKKLTADSQAVIRSGECSPYANVILCAGVTF

SEQ ID NO: 9459 - protein, 139 aa, Salmonella enterica serovar Schwarzengrund CVM19633; identical to SEQ ID NO: 9458

SEQ ID NO: 9460 - protein, 139 aa, Salmonella enterica serovar Agona SL483
MKKGTVLNSEISSVISRLGHTDTLVVCDAGLPIPNSTARIDIALTQGVPSFMQVVDVVTREMQVEAAILATEIKQQNPQLHETLLTHLEQLQQHQGNTIKISYTTHEQFKKLTADSQAVIRSGECSPYANVILCAGVTF

SEQ ID NO: 9461 - protein, 139 aa, Salmonella enterica serovar Dublin CT 02021853; identical to SEQ ID NO: 9458

SEQ ID NO: 9462 - protein, 139 aa, Escherichia coli O157 H7 EC4115
MKKGTVLNSDISSVISRLGHTDTLVVCDAGLPIPKSTTRIDMALTQGVPSFMQVLGVVTNEMQVEAAIIAEEIKHHNPQLHETLLTHLEQLQKHQGNTIEIRYTTHEQFKQQTAESQAVIRSGECSPYANIILCAGVTF

SEQ ID NO: 9463 - protein, 131 aa, Alicyclobacillus acidocaldarius DSM 446
MKRSGILHGRLSQIIAELGHGELIAVADCGLPIPPGIELVDLAIKPGMPSFLDVCDTILTELVVEDFIVANELAIRGSGVVDHLRERAGVLGKFIPHSDFKQTLRNVRSVVRTGEWTPYANVIFVAGVAFS

SEQ ID NO: 9464 - protein, 301 aa, Anaeromyxobacter dehalogenans 2CP-C
MLPVLFRIPLPGGASLPLHTYGLLIAIGFMVGIWLAQREAVRRGQDPRRLADLAFWILVSALVGSRVYYMLVNPGEFFSPARFLVETPFGRIPRVLAIWQGGLVFYGGFIGAALTAAWYLRRHRMGFLEHADTLIPSVALGHFFGRLGCFGAGCCWGDVAHGHLPWAARFPPESLAFQSFADRPDPGQYLAPDRLATLPLHPTQLYEAFGELGLFLLLVLVVRPRKRFHGQVLAAWLMLYAVLRTGVEAFRGDVERGVILGLGVGQWTSIAIFAAGATVWARARRPAPAGAGPAAAPAGGR

SEQ ID NO: 9465 - protein, 360 aa, Anaeromyxobacter sp. Fw109-5
MHPELLQLVVPEGLGALVALAVLVIFVVGRAAARLREARRAEEPLPVVAAFRADWPTSAALAAAALWLWRAGALDRELRLSLHSYGVLIAAAFLSGIWLAQREARRCGLEAGRIADLAFWVLVAALVGSRVYFILVNWGEYFGPGRFLLATPVGRIPRVLAVWEGGLVFYGGFIGAALAAALYMRRHRMPFLAYADVVIPSVAFGHFLGRLGCFAAGCCWGGLAGEHLPWAARFPPESLAYRTFLDRPDPAQYLAPGGATTLPLHPTQLYEAFGELALFLVLVLVVRPRKRFHGQVLASWLLAYAVLRTGVELFRGDVERGVYLGLGAGQWTSFALLAAGAAVWVSARKTRPAPAAAGAP

SEQ ID NO: 9466 - protein, 258 aa, Candidatus Desulfococcus oleovorans Hxd3
MHPVLVKIGPLTFHTYGLFVAGAILAAVWMGSRLAKARGISPEKVMDLTFYAVLAGLAGARLFYVLLNPSLFRGDWLGILRVWEGGLVFYGGFIGALTAVLVYIRRHRLAGGTIFDILAVAAPLGHAIGRIGCFFAGCCHGKVCDLPWAVTFTDPMTLAHPVGVPLHPTQLYEAFANLLIFALLSALYHRKKFANRLFLVYVMVYGIARAIIEIFRGDPRGFLFDGMLSTSQALGLTAATVAALLLVVLHIRNKRADR

SEQ ID NO: 9467 - protein, 301 aa, Anaeromyxobacter sp. K
MLPVLFRIPLPGGAFLPLHTYGLLIAVGFMVGIWLAQREAARRGQDPRRLADLAFWILVAALVGSRVYYMLVNPGDFFSSARFLVATPFGRIPRVLAVWQGGLVFYGGFIGAALTAAWYMRRHRMGFLEHADTLIPSVALGHFFGRLGCFGAGCCWGDVAHGHLPWAARFPPESLAFQSFADRPDPGQYLAPDRLSTLPLHPTQLYEAFGELGLFLLLVIVVRPRKRFHGQVLAAWLMLYAVLRTGVEAFRGDVERGVVLGLGVGQWTSIVIFAAGAAVWARARRSGPSGAGAAAAPAGGR

SEQ ID NO: 9468 - protein, 276 aa, Dictyoglomus turgidum DSM 6724
MYPKLLTIPQFQFLKYKIGPIVIYSWGTFVALGFLIGILLAMRWAKRENIDPDHVLNVAVWSIISSIIGARAVYVIKYWNAYKTNPITILHLWDGGLIFFGGFLVALVVVLLYLKRYKIDYWKFLDILAPAVAIGSAIGRIGCFLNGCCYGYETPLLWGVKFPNVYGYRHATELYYTIAFLIVFIYLLRVKSRKTFDGEVATNFFIYYSFAFFLVEIFRDNPRNFLYLTGSQTVSLLLIAFGIYAYRRRRAGRPIIPEQCLFWKIMTTKPKVSKKR

SEQ ID NO: 9469 - protein, 301 aa, Anaeromyxobacter dehalogenans 2CP 1
MLPVLFRIPLPGGASLPLHTYGLLIAVGFMVGIWLAQREAARRGQDPRRLADLAFWILVAALVGSRVYYMLVNPGDFFSPARFLVATPFGRIPRVLAVWQGGLVFYGGFIGAALTAAWYLRRHRMGFLEHADTLIPSVALGHFFGRLGCFGAGCCWGDVAHGHLPWAARFPPESLAFQSFADRPDPGQYLAPDRLSTLPLHPTQLYEAFGELGLFLLLVIVVRPRKRFHGQVLSAWLMLYAVLRTGVEAFRGDVERGVILGLGVGQWTSLVIFAAGAAVWARARRSGAVGAGAAAAPAGGR

SEQ ID NO: 9470 - protein, 261 aa, Desulfomicrobium baculatum DSM 4028
MFPTIIEIAPFILFGLKLGPFTLHTYGLFVAAGFLLGIAWSMREARARGLSPDTVSDLGFYIILGAILGARALYVLINPTYFWNNPQEILMFWKGGLVFSGGAIMATLFALAFLRIRKENPWLWMDVLAPGIGLGEAVGRIGCLAAGCCYGAVCDLPWAITFFDPESLAPLHVPLHPTQLYHSLAGLICFAVTLALKSKTQGTGQLMGIFLTLFGTLRFVIELFRADYRGDFGPISVTQIIALGAVALGLFIIQHRRRNVL

SEQ ID NO: 9471 - protein, 249 aa, Desulfohalobium retbaense DSM 5692
MHPILVDIGPFTVYTYGFFVAAAFLVGMAVSMREAKRLGLPHKIVPDLGFYLILSAVVGARLLYVLLAPKYFLAHPLEIVQFWKGGLVFLGGALAAAGTTIWFLRRREQPIWSWADAIAPGLTLGQAVGRLGCLAAGCCFGKECTLPWAITFTDPKSLAPLHQALHPTQIYHVLAGVAVYFLLLGTKRWQPKPGMRFAIYIMGYAVLRFVIELFRGDFRGHLGPLSTTQWIAAALVILGIWLYRQRRNS

SEQ ID NO: 9472 - protein, 158 aa, Ralstonia eutropha JMP134
MLDAARRARAAGFTHLEAFTPYPVEGLAEAIGMTADRMPLLALLGGLTGGLGGFLLQWYAAVIDYPLNIGGRPAGSWQMFVPVTFSLTILGAALTTVIGMLVANRLPRLRHPLFDAPDFEQASRHRFFLCIRPEAAQATAAFRMLATTAPLRVSEVPQ

SEQ ID NO: 9473 - protein, 180 aa, Nitrosococcus oceani ATCC 19707
MNKIAIKNYGLMAEFETPELLVQAVRESRLNGYQAVEAYTPFPVEGLDEALGLRRDSLPFFALVGGCIGAVSIYFVEYYSATIDYPINSGGRPYHSWPAFIPPAVEMAILGAALAVVLGMLILNRLPKLRHPIFGVSQFDMAERDRFFLCISAHDPLFDENRAQRFLESLEPAGIHKVKG

SEQ ID NO: 9474 - protein, 145 aa, Pelobacter carbinolicus
MPRQLFFDTPEAFLQELRAQLASGVPRRCLQVHLPYHLHEVEELLIGRPSRLRYFALTGGLAGFGGGFLLALLTSIDWPVITGGKPIVSVPPFLLVGYLMTILIGSLSCFAGFLWLARLPSPEILLAGQPFESRFVLSIQDEDAT

SEQ ID NO: 9475 - protein, 175 aa, Anaeromyxobacter dehalogenans 2CP-C
MKSYVLGEFGAEAALLDAARTLRARGGATLDLHSPYPLHGAEEALGLRKSTVPLVALVAGITGAVSGYLLQWYTVGYAWPLNVGNRPPHSAPAFIPVTFELGVLFSALAIFVGLLAVYFGFPRVHHPVFEVEAFRSASIDGLWLSAEVEAGDADAVAAELRRLGARLVSVVPEGK

SEQ ID NO: 9476 - protein, 174 aa, Nitrobacter hamburgensis X14
MTKPLIAEFSDADSLISAAVRLKREGHQLLDAFTPFRLPELDSILIVKPSRIRLSMLVGGLAMAAFFYFLQWYSSVIDYPLNTGGRPLNSWPVFLLVPFEVGMLAAALSGFAAFLWTCRLPRLYHPIFDTTDFARATQDRFFLLAAQTGKEERSASLRKLLKHSGAVAVREQGS

SEQ ID NO: 9477 - protein, 181 aa, Candidatus Koribacter versatilis Ellin345
MEHAPATPIYGLMAEFDDIGSLLNAAKKAYAAGYRQMDAYSPFPNEELSDAIGFPKTRVPLIVLIGGIMGGLSAFALQYWCSAISYPVVVAGRPYNSWPAFVIPCFELTILFASLSGVFGMLALNGLPMPYHPVFNVDRFAAASRDKFFLCLEAADPMFDRIRSEQFLADLKPEFITEVPH

SEQ ID NO: 9478 - protein, 176 aa, Cytophaga hutchinsonii ATCC 33406
MEKGKNFVFGVYDDEAVLMNAVDQIRAKGVKIHEVYTPYPVHGLDNALGYSYSNLPIAGFLFGIVGTITALSMMIGMLGFDWPMDIGGKPHIPLPAFIPITFELTVLFCALGMTGTFFVASNLNPWSTPQMFDPRTTDDKFVIAFDTASNKHDSAALKSILSETGASEVTTKSLEN

SEQ ID NO: 9479 - protein, 174 aa, Flavobacterium johnsoniae UW101
MSNKVIYAIYNDDDVLMNAVKKTRAAHHHIEEVFTPFPVHGLDKAMGLAPTRLAICAFLYGCVGISVATTMMSYIMIHDWPQDIGGKPSFSFIQNMPSFVPIMFEMTVFFAAHLMVITFYMRSRLWPFKQAENPDVRTTDDHFLIEVAVNDNEAELVSFFEGTGAVEVKVIEKN

SEQ ID NO: 9480 - protein, 192 aa, Roseiflexus sp. RS-1
MLKRNAMRAKAPKVSTEPGLYGLIAEFDSADALLAAAEKTRDAGYKKFEAYTPIPIHGLDEAVGYRGTRLPWVIFGAGLLGASGMFALQTWINVVEYPMNVGGRPLFSWPAFIPATFEGMVLLSAFAAVFGLIAACGLPRPYHPVFNAPNFERASVDRFFLCIEAADPKFELKRTRQFLESLEPLAVSTVDN

SEQ ID NO: 9481 - protein, 175 aa, Anaeromyxobacter sp. Fw109-5
MRAYVLGEFEREHALLDAARTLRARGEARLDIHSPYPLHGTDEALGLKRSTVPLVALIAGVTGAATGYFIQWYMVAFDWPINVGNRPPHSAPAFIPVTFELGVLFAALAIFFGLLGGYFGFPRTHHPVFEVEAFRSASIDALWLSAEVDGKDAEPLAEELRRLGARHVSIVPEAK

SEQ ID NO: 9482 - protein, 192 aa, Roseiflexus castenholzii DSM 13941
MLKRNARQPKALKVSTGPTLYGLMAEFDDAEALLAAAEKTRDAGYKQFEAYTPMPIHGLDEAVGYRGTRLPWVIFGAGLLGASGMFALQTWINLVEYPLNIGGRPLFSWPAFIPATFEGMVLLSAFAAVFGMIAACGLPRPYHPVFNAPNFERASVDRFFLCIEAADPKFELKQTRQFLESLGPLAVSTVDN

SEQ ID NO: 9483 - protein, 172 aa, Methylobacterium extorquens PA1
MSAPLLAEFNNPDALVRAMRLATADGHRALDAFTPFPVPDLTNAFAPPRNLVRPVMALTGFGAAAAMYALQWYSSVIDYPLNTGGRPLHSWPVFLLVPFEFGVLIAAITGLIALFWTCGLPRLHHPLFAIPQFERASQDRFLLLVASKDTDATALRESLERAGALLVAEMHP

SEQ ID NO: 9484 - protein, 175 aa, Methylobacterium radiotolerans JCM 2831
MSAASRAPLLAEFETPDALVRALRLVRGDGHRPLDAYTPFPLEELSGALPPARNPVRFVMAVAGFGAAAAMYGLQWYSAVVDYPLNSGGRPLHSWPVFTLVPFEFGVLAAAVAGFAAMLWACGLPRLNHPVHDMPQFERASQDRFLLLVAPKAEPAALRLRLEEAGAVLVSELRA

SEQ ID NO: 9485 - protein, 180 aa, Opitutus terrae PB90 1
MSSVSVQPYGLIATFQTPAAVYHAAEQVRDAGYKYWDVIAPCPIHGMDKAMGLKRSIVPRISLVGGITGFCTGMTSIWWMNAYDYPLIVGGKPYFSPMFAFPISYELTILFTAFATIIGMFLVNGLPMHYHPVLKYPKIKRGMDDQFFIVIEARDPRFNAANTRTLLEKAGGGEITELEA

SEQ ID NO: 9486 - protein, 172 aa, Methylobacterium populi BJ001
MSAPLLAEFETPEALVRAMRLAQADGHRALDAFTPFPVPDLTDAFAPSRNPVRPVMAVAGFGAAAAMYALQWYSSVIAYPLNSGGRALHSWPVFLLVPFEFGVLAAAIAGLVAMFWACGLPRLHHPLFAIPQFERASQDRFLLLVAAKDADATALRESLERAGALLVAEMHA

SEQ ID NO: 9487 - protein, 186 aa, Akkermansia muciniphila ATCC BAA 835
MKKPVISGWVLSFGSEKALLQAVRVLVKEENLRWEVCAPYPCAAVRFANRHAGKAVGAGVRLWAAAGGVCGFLAVALWLYWTQFCADPLVTQGRVQGWDSWPAYVPPLFEGTLLGAGLLTAAGFLKGALLPQWHDWAFECDFFRTDEHGNGYFILLEGGSEGYAAVLAEALHPDACEYVHGKGGRA

SEQ ID NO: 9488 - protein, 175 aa, Anaeromyxobacter sp. K
MKTYVLGEFGAEAALLDAARTLRARGGATLDLHSPYPLHGAEEALGLRRSTVPLVALVAGITGAVSGYLLQWYTVGYDWPLNVGNRPPHSAPAFIPVTFELGVLFSALSIFVGLLAVYFGFPRVHHPVFEVEAFRSASIDGLWLSAEVDGGDADAVAAELRRLGARQVSVVPEGK

SEQ ID NO: 9489 - protein, 172 aa, Methylobacterium sp. 4-46
MGEMLACFADPHSLVRAARTLRARGHRPLDTFTPYPVEAVEGVLDPRPSRLRWAMLAGGVGAAAFAYLLQWYAAVIDYPLNSGGRPLHSWPVFLLVPFEVGVFAAALAGLLAFLWGTGLPRLHHPLFAVPGFERASQDRFFLLAAAAAPGDGTALRHLLEETGALVVFEVRP

SEQ ID NO: 9490 - protein, 172 aa, Gluconacetobacter diazotrophicus PAl 5 JGI
MIVAAFATEAGMRKAAAEIRRGDPGFVETYMAMEPREAEDDGAGDGHMAGGSILPAVMLFGGIVGGLGGFLMQAYATTISYPQNIGGRPDLSWPSYVPTTFELAVLGAVVAGMAGYLLLARMPRLYDPVDEAECMRTAMLGFYVLVARPTDSARAHRVLARHAPIGIEEVAE

SEQ ID NO: 9491 - protein, 172 aa, Methylobacterium chloromethanicum CM4
MSAPLLAEFDNPDALVRAMRLATADGHRALDAFTPFPVPDLTNAFAPPRNLVRPVMALTGFGAAAAMYALQWYSSVIDYPLNTGGRPLHSWPVFLLVPFEFGVLIAAITGLIALFWTCGLPRLHHPLFAIPQFERVSQDRFFLLVASKDTDATALRESLERAGALLVAEMHP

SEQ ID NO: 9492 - protein, 175 aa, Anaeromyxobacter dehalogenans 2CP 1
MKTYVLGEFGAEAALLDAARTLRARGGATLDLHSPYPLHGAEEALGLRRSTVPLVALVAGITGAVSGYLLQWYTVGYDWPLNVGNRPPHSAPAFIPVTFELGVLFSALSIFVGLLAVYFGFPRVHHPVFEVEAFRSASIDGLWLSAEVEAGDADAVAAELRRLGARLVSVVPEGK

SEQ ID NO: 9493 - protein, 175 aa, Methylobacterium nodulans ORS 2060
MGEMLAAFADPQSLVRAARTVRERGHRPLDTFTPYRVEDAETVLEPEERPTRIRWAMLIGGFGVAALAYGIEWYSAVIDYPLNSGGRPLHSWPVFLLVPFEVGVFAAALTGLLAFLWGSGLPRLHHPLFEIPGFERASQDRFFLLAAETNAEGDGIALRHLLEEAGALVVFEVRR

SEQ ID NO: 9494 - protein, 186 aa, Rhizobium leguminosarum bv  trifolii WSM1325
MREPSADIEPFGILVEFDAGERLVEAAGRTRAEGFCSLDAYSPFPLPGLSAALDVEDNRVPWITILGGGFGAAAGYAMQIYTNWDFPIDIGGRPLFAWQPFMLITFETCVLFTVLAAVLGMLLLNRLPRLHHPVFDIDRFNLVSTDRFFLIVFGNDPRFDVEATAEFLRSLNPVMLFIVGQTEEPE

SEQ ID NO: 9495 - protein, 178 aa, Pedobacter heparinus DSM 2366
MNNIKYILGSFGDPDEMMHGIEKLQENNIKIHDVYTPMPIHGIEAKLGVKRSRLDIAAFFFGITGTCTMLTFVYFAAAYDWPINIGGKPHFALPDFIPITFELTILFCAFGLVGSYYASTHLFPGRAPRVMDLRATDDRFIIAIDAKENTEHSKIDDLLKQAGALEVKHNERKYVSYE

SEQ ID NO: 9496 - protein, 176 aa, Dyadobacter fermentans DSM 18053
MAELSGKYLVGVYDDDDTVLHAVPKLRKAGVKIKEVYSPFPIHGLDEALGHPRTRIGIAAFMFGVTGCCAVLTLMIWTMGYDWPMIIGGKDPISIPNYIPITFEGTVLFTAFGMVTTFLISNGLGPGSHFHPRFDVRATDNKFIMAIDMSRNSMSEEEISRALKDSGAEEVNIKQF

SEQ ID NO: 9497 - protein, 179 aa, Chloroflexus aggregans DSM 9485
MRNDVYGVIAEFPTPEALIEATRKAKAAGYTKMDAFSPFPIEEVIEEIAHGDTGVPRLVLLFGLIGAATGFILQYIGNLIDYPLNIGGRPLDITNWPAMIPITFESGILLASFASAIGMVVLNGLPAPYHPVFNVPRFQYASQDAFFLCIESTDPLFDRSRTSQFLRSLNPMQVSEVPY

SEQ ID NO: 9498 - protein, 197 aa, Chitinophaga pinensis DSM 2588
MAVKNFVVASFSDEAVLFPAVKKVRTAGYKLHDVYTPFPVHGLDHAMGLRETSLHTAGFIYGITGTTTALSCMSWVFNSDWPMNIGGKPHFPLPAFIPITFELTVLFSAVGMVLTFCYLCQLAPFVKKHIFNPRQTDDKFVMAIEVTAKTNAEELKRFLAGLGGEDVNEQRVESGWWFGRFDREDRLFETKVEAVNA

SEQ ID NO: 9499 - protein, 182 aa, Arthrobacter FB24
MSALHLVPTSPALERPAAGDQPARRLAAVPAAGSPAPRQHTAGTPPTPRPGDPGDATKNGRALQIVSENKEVCAITRGTVQAAIEVLAGTRPIQQLSRRLDQRCLASLQHRAALTRRLAAGPSPTAGRLHRNPAVRSVRACEVASGVYEASAVVVDELRVRAVAVRLERSNQVWRITALEIG

SEQ ID NO: 9500 - protein, 172 aa, Nocardioides JS614
MNNPETDQTVVVLRAAAVPLASVQGTLALDLQPRFDPPDPIVPHGHAAADVIAIEQPLRRGLEQWARRYTQAAVEIVGGDRPVSQLLRWSSREVYENLDRRAQLVARAGRHQPGQGRVQPVRPRVLGVHTCFLSRDAVEVSAHVRYGERSRALAARFEITGQRWCCTALEFA

SEQ ID NO: 9501 - protein, 197 aa, Salinispora tropica CNB-440
MTAVRRPEPTRPPVRLRPAPSIDPPCAEDDPARRPLDGQLALDLFQTGPDPLPRPPGQRRRAGPGPAGPRRAPTRVPATTLVTATPEAIRVAHRFVTTCLEVINGYRAPSQLRRLLDPTRAAELVPELTRATGRAGPVRRRSTRPGTRLRRLRVCEPRDAVVEAAAVLAGPAGWTWAMAIRLEQRRGSWLCTALNVL

SEQ ID NO: 9502 - protein, 241 aa, Frankia EAN1pec
MTATTALTLPRRRRPHVATTPRLMPVRPIDPPYDDETVPPEQTAPAGRAPGTDRSAGARYSRVAAPTTTPNAPSTAMGAPARMVSRAERGAARHLLPDQRTLPWPQPARTTRTPARQPADGAAAVAPRLAARAPTGPGTSPDPRRTAAVVVRVIIEVLSGARPAAHLAPWSTAALQSDFQRTASSLATRQPSQVRSVRVSEPLPGVAEVSAVVSRGPRVRALALRMEHAAGRWQVTTLQLG

SEQ ID NO: 9503 - protein, 195 aa, Salinispora arenicola CNS-205
MSDVRRPEPARPPVRLRPAPSIDPPYAEDDPAHWPIDGQLTLDLSKAARDPLPRPPGRRRGPGSAGPRRSPAPLPATALVTATPEATRIAHRFVITCLEMLNGYRPPRQVRPLLDPARAAELMRELARATARSGPVRRRSTRPGTRLRRLRVCEPRAAVVEAAAVLTGPAGWTWAMAIRLERRRGSWLCTALHIL

SEQ ID NO: 9504 - protein, 175 aa, Arthrobacter chlorophenolicus A6
MPAVTPIRALQGRTASNVEKGFANGTTSQEALRQTQLRALGPGRLAPHPGAPVQLRAADEEAEVRALTRGTVQAAMEVLAGIRPVHQLARRLDPRCLAALQHRAALIRREITRTGNPALGRLHRNSIVRSVRICEVAEGTYEASAVVVDDVRARAVAIRLERSKQVWRVTELVIG

SEQ ID NO: 9505 - protein, 133 aa, Brachybacterium faecium DSM 4810
MTTTDQRPVPSGTSTSSLAPQDPRSVEQLVAPVARRAVEIVRDMRPENSLSRLVTPEVGQHLARRAALTRRLRASTGYAPTRQLEVTGVRICVVNARTVEASCVLREPDRARFLAMRWELRHSGWRVTVLEIG

SEQ ID NO: 9506 - protein, 170 aa, Micrococcus luteus NCTC 2665
MTALATRPRTASARRTADTLLHGPAHSPAVLPRGEEIARRARTEQGREELRRVRSLAAVIAVACVEVETGRRALRDLSAWLSPEVLDKLTRRMELLGAVAPAGPGRRPAPAVPPRAPASAPRPVGARVCEVAPGRVEASATVLWEGRARAFALRLERRLSRWKVTSVEIG

SEQ ID NO: 9507 - protein, 128 aa, Kytococcus sedentarius DSM 20547
MRAQQGAAEIGFFDRQPTSTADLSPALPWAAHLSRSIIEVMEGSRDPQQLTRWVAPDILTRLARRNALSRRFGTATGATGVRTVRACHVRDGIVEVTAVVVIRNQVRALALRLEGLDGRWLLTVLEVG

SEQ ID NO: 9508 - protein, 379 aa, Catenulispora acidiphila DSM 44928
MTPVRSVRAIGTAGVGAHWRRDNRPDFPGIAVWVDAVAEIEIETGAFGDSDEEGEFSAGERAGGESRSSGRGSDWADGERGSAGQGDSERADGESRGSRHIGDWADSESLGSDQGAGARASAARLGSDWVDGESRGSDQSAGARANGQRLGGDWADGESLGSDQSAGARPNGQRLGGDRSAGSQDSDDAGLVPSSVDAWSPEYAKVWRPLSGAGREPRPGLLVSVVRAGAVVAYPTPLPDPPTGALARALARLERPAVERRPHILPIEAAPAPAPPRRPAPSQKTYGEVRALVGVLVEILRGHRAATHAARWTDPEVRGKLRTPRYARTASLKSVRLAESGDGVEALALLQEGGRTHVVALRFDRAEDSRWRCTALQTG

SEQ ID NO: 9509 - protein, 159 aa, Saccharomonospora viridis DSM 43017
MRTFQSDNGLLPLSPYEPAELGDLAKGEIAEGQLTLDDLLAELHAQHPTHYERTIPAPGRRMLHRVLTALLEVHTGRRAAAQLDNWLTPTLQRLIRTAPRAVGTRYVLRNIHVCRPADDALEVCGTAYLNNRARALVARFEHGVTGWRCTLFTMLEPRR

SEQ ID NO: 9510 - protein, 150 aa, Jonesia denitrificans DSM 20603
MTSTLDSVLLPASPPVRDALPAHLITEDTPHEDRLARGRELGDPTAICCAVARSAVEAFHGIRPIHQLVSRLAPHVLESLTARAQVRASLNTGTATRHQPVRIVRARVVRVSPIAAEATVIIADGSRVRAAAIRVEEHRGRWRAVDLQIG

SEQ ID NO: 9511 - protein, 299 aa, Rhodoferax ferrireducens T118
MTEPSLNYVLCPDTSGGHRMAYWQWGNPEAGHVVVCVHGLTRQGRDFDVLAQALCERAGDSLRVVCPDVAGRGQSDWLKDPQGYQIPVYAADMLTLLTALQPTTLDWLGTSMGGLIGIVLAGQPELPLPVPVRRLVLNDVGPVMEWQALQRIGEYLGQTGRFDSLQQAADALWVIASSFGPHTAAQWLALSQPMVRPLGDGSGALTLHYDPALALAFRALTPESAAQSEALLWQLYDQITARTLLVRGAVSDLLTMQTARAMMARGPQARLAEFAGVGHAPTFIACDQVKAVASFLLDD

SEQ ID NO: 9512 - protein, 309 aa, Polaromonas JS666
MTEPSLNHVTCPDASGGHRMAYWQWGRPDSGHVVVCVHGLSRQGRDFDVLAQALCQQAEQAAPGSGGLRVVCPDVVGRGESDWLKDPMGYQLPAYAADMLVLLAHLHARAPITTLDWVGSSMGGLIGMGVCGQPGLPLPVPVRCLVLNDVGPAIEWNAIVRIGTYLGQAGHFGSVQEAADAMRAVSSSFGPHTPEQWLALSRHMVKPVSQSADSKWRLHYDPAIAVPFKLATEASTLQGEAALWKLYDHISARTLLIRGALSDLLSSETAYAMTQRGPRARLVEFEGIGHVPTLIADDQVAAVTGFLLG

SEQ ID NO: 9513 - protein, 330 aa, Acidovorax avenae citrulli AAC00-1
MPQRRLPAMTEPTLNYVHCPGAAASPGTTTEGEGGHRMAYWEWNATGDPAHPHVVVCVHGLTRQGRDFDVLARRLARHARIVCPDVAGRGRSDWLADASHYQIPVYAADMLALLGHLHVRAPVRVLDWVGTSMGGLIGMALCGQPELPLPAPVRRLVLNDVGPTLEWPALQRIGQYVGRVVEFSSVAAAVEGLRIVSTGFGPHTAEEWQALSEPLLRPQPDGSVRLHYDPAIAENFRNLTPESARAGDAQLWQLYDAIRARTLVLRGAESDLLLPATTQAMAQRGPRARVVEWPGVGHAPTLVAAEQVDVVEQFLFGAGQGGPGAVEARP

SEQ ID NO: 9514 - protein, 311 aa, Acidovorax sp. JS42
MIQPTLKYVPCPGPVAAGHPEQGHRMAYWEWNETGDAAHPHVIVCVHGLARQGRDFDTLARALARHARVVCPDVVGRGRSDWLADPMQYQLPVYAADMLALLVQLHSQGPIATLDWVGTSMGGLIGMGLCGQPGVLPVPVRRLVLNDVGPRVEWQALARIGQYLGQPAHFATLQQAADALWAVSRSFGPHTPAQWLELSRAMVREAPQGGLALHYDPAIAVPFRALTPEAALAGEQQLWQLYDQIPAQVLLLRGAESDLLSSATAREMTARGPRARLVEFAGVGHAPTLVQPDQVAVVAQFLLERQEELTA

SEQ ID NO: 9515 - protein, 306 aa, Polaromonas naphthalenivorans CJ2
MTEPSLNYVTCADAAEGHRMAYWQWGQPDSPHVVLCVHGLTRQGRDFDVLAQALCERAGASSSGGIRVVCPDVAGRGESDWLKDPMGYQVPAYAADMLSLLAHLQARSPISTLDWVGTSMGGLIGMVVCGQPGLPLPVPVRKLVLNDVGPTLQWQAIQRIGAYLGQSGHFNSVQEAADAMWKISESFGPHTPEQWLALSLPMIKPVSPDAGSPLRLHYDPAIAGPFRLTTEEGAQQGEATLWQLYDGIQAETLVLRGAQSDLLSPQTAHAMTQRGPRARVVEFEGVGHAPTLVAKDQVAAVADFLL

SEQ ID NO: 9516 - protein, 292 aa, Verminephrobacter eiseniae EF01-2
MHRMAYWEWRGWGAWNDTGHPAHSRVVVCVHGLARQGRDFDSLARALSPHARVICPDVAGRGQSDWLADPMAYQIPQYASDMLALLAQLQQSGPISTLDWVGTSMGGLIGLVIAGQPGLPLPVPVRRLVLNDVGPVIQWQALQRIAQYLGRWGQFDSLQQAADALWSVSSSFGPHTPAQWLELSRAMVRPLPQGGLALHYDPAIAVPFRSAYSTPESVTAGEAALWRLYDQITARTLLLRGVQSDLLAPATAQAMAGRGPRAHVVEFEGVGHAPMLMAADQLAAVTQFLLAQ

SEQ ID NO: 9517 - protein, 296 aa, Methylibium petroleiphilum PM1
MTEPRLDFVPCLDTQGLHRMAYWEWGERDNPRVVVCVHGLTRQGRDFDTLARALAADYRVVCPDVAGRGRSDWLADPAGYQVPAYVADMVALLARIGAPQVDWVGTSMGGLIGLGVASLRDGAGGTLVRRLLLNDVGPALGADAIQRIGTYVGLPKRYASLDEAADYLWSISKGFGPHSREQWLALTKPQLKPVQDAQGEGFVSHYDPRIGLPFKAVTPALAAAGEAMLWQRYDSLRCPTLVLRGAESDLLSHETALAMTQRGPKARLVELAGVGHAPTLVAADQVALVQEFLASP

SEQ ID NO: 9518 - protein, 626 aa, Polynucleobacter necessarius asymbioticus QLW P1DMWA 1
MSGSHHFHSHSKPIKPHSQSGVDPSLHAHKKGDARHSHTKQVSNQNLILIALVLTLGFSGVEGAAAYFANSLALISDAGHMVTDAAALGLALLAQIIARRPPSPRHSFGFGRAEALAAFVNSIAMLALVLWIVIEAISRFANPHKVDGLTVTVVAAIGLLMNVVVAWVLSRDTKSVNTRAALVHVMGDLLGSVAALIAGIVIQLTGWMPIDAILSILVSLLILKSTISILHESYHFLMEGVPLHIDYLAVGRDLKAVPGVLAVHDLHVWEMTPSFPALIGHIEISDMQEWPSIMAKINAMLLDKHGIDHVTLQPEEVGQDEHDHEHDDHGLNTEEKPTTFLHQGDTFYVQCSSGESEHRMAYHVWGDPTNPKVLLCVHGLTRRGSDFKTLAQAMCKDYYVVCPDIVGRGESDRLSNPMLYAVPQYVANIAQLIKKLGVSQVDWLGTSMGGLIGMVYAAMPNCPIQKMLINDVGPRIEPEALKRLGSYVGQPFVFGNRADALERLNKICASFGEHTPQEWEIYNGPMLIQKDEQWIMHYDPNISVPFASVNPIMAKAGEMAMWHAFKQIRIPMLIVRGGDSDLLSAATVAEMCKINPYARSIEIPHVGHAPAFVKPEQIALAKEFFS

SEQ ID NO: 9519 - protein, 335 aa, Delftia acidovorans SPH-1
MNHPTLNYVSCPAVAGRASPWSRTASPAAQDNASHRMAYWEWNRTGDPNHPHVVVCVHGLSRQGRDFDVLAERLSERARVICPDVVGRGESDWLQDPAAYQVPLYAADMLALLAQVHAQAPVEQLDWVGTSMGGLIGMALAGQPGLPLPVPIRRLVLNDVGPVIEWSALERIGQYLGKGVHFENLEQAAHALLLISEGFGPHSEGQWLRLTRPMMRPAADGGLVLHYDPQIAVPMQQMTPEMAQAGEALLWQLYDQIKARVLLVRGAQSDLLTAATAQAMAQRGPKAHCVEFEGVGHAPTFVAAGQVALLCRFLWGEERLPSTMNLAEQARESDE

SEQ ID NO: 9520 - protein, 300 aa, Leptothrix cholodnii SP 6
MHEPRLHHVSCLDSQGLHRMAYWEWGDSDNPQVVVCVHGLSRQGRDFDTLARALAPQWRVICPDVVGRGQSDWLPDPMGYQVPAYVADMVTLIARLNVPKVAWVGTSMGGLIGLGLAGLRNSPVSRLVLNDVGPVIEYASLQRIGTYLGAPVRFADEVKAAAFLRSISASFGPHSDEQWLALSRPQLKRAPEGDLIPHYDPAIALPFRAVTPELALAGQALLWNSYDRVQVPTLLLRGAESDLLSRETAVAMTRRGPHARLVEFDGVGHAPTLVAPDQVECVRGFLAEGLVTAPEAAVPA

SEQ ID NO: 9521 - protein, 607 aa, Polynucleobacter necessarius STIR1
MNSGVDPSLHAHKKGDAKHTHSKQVSNQNLLLIALVLTLAFSGIEGAAAYFANSLALISDAGHMVTDAAALGLALLAQIISRRPPSPKHSFGFGRAEALAAFVNSIVMLVLVVWIMVEAISRFYDPHKVDGFTVTVVAAVGLLMNIVVAWVLSRNKKSVNTRAALVHVMGDLLGSIAALIAGVVIQLTGWMPIDAILSILVSLLILKSTISILHESYHFLMEGVPLHINYLEVGTDLKNVPGVLAVHDLHVWEMTPSFPALIGHIEIVDMQEWPQIMSRINAMLLDKYGIDHVTLQPEEVGEDRDHDHAGHDLHNDTQTANVFHDGETFYVDCASGDEKYRMAYHAWGNPSNKVLLCVHGLTRRGSDFKTLAQAMCNDYYVVCPDVVGRGDSDRLSNPMLYAVPQYVSDIATLVKKLGVSQVDWFGTSMGGLIGMVYAAMLNSPIRRMLINDVGPRIEPEAIKRLGSYVGQPFAFSSRADALNRLNEICASFGEHTAQEWEIYNGPMLVQKEGKWIMHYDPDISVPFASVNPIMAKAGEMAMWHAFKQIHIPMLIVRGGNSDLLSAATVAEMCKVNPYARSIEIPNVGHAPAFVKSEQIALAKEFFS

SEQ ID NO: 9522 - protein, 311 aa, Diaphorobacter TPSY uid29975
MIQPTLKYVPCPGPAAAGHPEQGHRMAYWEWNETGDAAHPHVIICVHGLARQGRDFDTLARALARHARVVCPDVVGRGRSHWLADPMQYQLPVYAADMRALLVQLHSQGPIATLDWVGTSMGGLIGTGLCGQPGVLPVPVRRLVLNDVGPRVEWQALARIGQYLGQPAHFATLQQAADALWAVSRSFGPHTPAQWLELSRAMVRETPQGGLALHYDPAIAVPFRALTPEAALAGEQQLWQLYDQIPAQVLLLRGAESDLLSSATAREMTARGPRARLVEFAGVGHAPTLVQPDQVAVVAQFLLERQEELTA

SEQ ID NO: 9523 - protein, 319 aa, Variovorax paradoxus S110
MTEPTLHYVACDDAQGGHRMAYWQWGDARSARVVVCVHGLTRQGRDFDVLAEALVARAAGDVRVVCPDVAGRGQSDWLRDPALYQVPVYAADMLALVAQLHRERPINTLDYLGTSMGGLIGFVLAGHKQLPLARPIRRFVVNDVGPTIEAAALQRIGAYVGQGGRYDSVQSAADAMWTISTSFGPHTPDQWLSLSQHMVVPASQRTPDGAGKVEASESHGDAAGPWLLHYDPAIAVALRAITPEAAVQGGAVMWSLYDAIDARTLVTRGAQSDLLSRETALAMTQRGPRAALVEFEGVGHAPTFVDPVQVGAVTNFLFD

SEQ ID NO: 9524 - protein, 379 aa, Dechloromonas aromatica RCB
MSPLLPKQSILVVDDSPENIDLLSEVLRDEYRIRVATSGEKALKIVYSDEPPDLILLDIMMPGLSGLEICRRLKANPDRRRIPVIFVTAMSSMDDEKRGLETGAVDYITKPISPPIVKARVRTHLALYDQSRELEHMVQQRTHELLTTRQQIIRRLGRAAEFKDNETGNHVLRMSHYARLIAHAHGLGEEASNVIFNTAPMHDIGKIGIPDSILLKPAKLDAEEWKVMYQHPIMGAEIIGKHDNELLETARIIALTHHEKWDGTGYPQGLKGEAIPLEGRIVAIADVFDALVSVRPYKAAVPLNEAMQYLESQSGLHFDPSLMDAFRKALPEILRIKEIYADENGALTDLEFHIKEIYDHKDDPQGYPENLASTNGGFE

SEQ ID NO: 9525 - protein, 302 aa, Nitrosospira multiformis ATCC 25196
MKILIAEDDTTSRLLFAATLRKLGHTVTAVEDGRKAWEAWQKDEYPLLISDWMMPDIDGLQLCRMIRGEPGLQYTYIILLTALDSKGSYLEGMDAGADDFITKPFDEEQLAARLRVAERILGLHQKLHIQATRDYLTGVWNRASIMDYLQKELKRGARQDICTSVMIADLDHFKRINDTYGHPTGDEILQEAARRMSGVLRGYDRVGRYGGEEFLITASGCDWSEALALGERICSSIRSEPANSRAGQIDMTVSIGIATSCGQVNDIGELIAAADQALYQAKEAGRNQVKLSRLPIESGPAP

SEQ ID NO: 9526 - protein, 340 aa, Shewanella amazonensis SB2B
MEKATVLVVDDTPENIDILVGILGQDYKVKVAIDGPRALALALKSPPDLILLDVMMPGMSGYEVCRRLKQEPMTAHIPVIFVTALAEVADETQGFELGAVDYITKPVSAPIVKVRVKTHLALYDQKRLLEEQVRERTKELEQTRFEIIRRLGRAAEYKDNETGLHVVRMSHYARLLARQAGLPEPFCELLYNAAPMHDIGKIGTPDAVLKKPAKLDAEEWEIMQQHASIGAEIIGEHPDPLLQMSRRIALTHHEKWDGSGYPNGLSGTEIPIEGRIVAIADVFDALTSIRPYKKAWSIEDTMALLESEAGKQFDPELVDHFKQILPEVVAVRDKHMETEG

SEQ ID NO: 9527 - protein, 308 aa, Halorhodospira halophila SL1
MMHEDPLPQWPTILIVDDEPTNIQALAHLLKDDYHIRVATGGAKALEIAAGTPQPDLILLDVVMPEPDGYEICRRLKADRATQNIPVIFVTGRDSAADEEHGLELGAMDYITKPFSPRITRTRVRNHVDLKRKTDALERLSQRDGLTDLPNRRVLDRQLPEEWSRCQRGDTPLSVIMMDIDHFKPYNDHYGHGAGDECLRRVARVLANVPSRTTDLVARYGGEEFIALLPYTDAPDAWQMAERFRAAVAALQLPHGHSSTDGIITMSVGVASHTADRPYDSPEQLLEAADQALYAAKKAGRNRVQAAQ

SEQ ID NO: 9528 - protein, 343 aa, Shewanella woodyi ATCC 51908
MDKSMVEKATVLVVDDTPENIDVLAGVLRDLYKVKVARNGEIALKITRSPSPPDLILLDVMMDGIDGYEVCRQLKEDHSTRHIPIIFVTAKIAQEDEVKGFELGAVDYISKPISPAIVLSRVKTHLALYNQNRELDRKVLEKTQEISDNQLKVVQRLGRAAEYKDNETGMHVIRMSHYTYVLALATGMSEKDAETLRVAAPMHDVGKIGIPDSILQKQGKLDEDEWQVMLTHAEIGAEILGDDSSEMLSIARTVALSHHEKWDGSGYPYGLKGEAIPMVGRIVAIADVFDALTSIRPYKQAWSVDEALGLLKEESGRHFDPSLVTLFIACIDDILEIKSKFQG

SEQ ID NO: 9529 - protein, 391 aa, Desulfovibrio vulgaris  Miyazaki F
MTDTPLHADDTRRTVLVVDDTVDNLTLLSDLLKDTYRVKVANSGEKALRILSSGSPPDLVLLDIMMPGMDGYTVLRRLKELPGTADVPVIFLTALSEEDDERIGLELGAVDYITKPISPSIMLARVRTHLQVKAARDFLKDKNEFLEDEVARRMRELAAVQDVTIMAMASLAETRDNETGNHIRRTQHYVKVLAQHLSEHPRFSAALTPEDIPLLFKSAPLHDIGKVGIADRILLKPGKLTPEEFEDMKRHPALGRDAIIAAEKQLDTPVSFLRHAREIAYCHHEKWDGSGYPQGLSGDGIPVSARLMALADVFDALISRRVYKPPFDMEKSVEIIRQGRGSHFDPDVVDAFLANLQTFRDIADRYTDSEETLEETRSRTEKDYPPSGARG

SEQ ID NO: 9530 - protein, 399 aa, Thioalkalivibrio HL EbGR7
MVFMNELHSSDPRKAQVISMAREAARRRTAPAQWRSGHAEGEGEYEYTPPAARMRLVIVDDQSTGRRILRELLQDVGQGVEIVDYAAPQDALLDVRENLPDLIVTDYRMPGMNGTQLIRAVRALPGGADVPIVVVTVLEDRNVRYEALEAGATDFLSRPLDPVECRVRCRNLLQLRRQGRLVRKRAQWLEQRVLAATQEVIKRERETLFRLAKAGEYRDEGTGNHVLRMARYARCVAEALGLDEVLCETIELAAPMHDIGKIGVPDHILLKPGELTPDEREIMMRHASIGHQILMESDSRYIQMGAVIALSHHERWDGAGYPQGLAGEAIPLPARIVAVADVYDALRSDRPYKSAWNRDAACDFLRDEAGRRFDPTVVAAFLSCFERICQVEDSLRDTT

SEQ ID NO: 9531 - protein, 347 aa, Azotobacter vinelandii DJ
MKATILVVDDVPENIDIFVEILAPHHRTKVALNGERALRIARSDNPPDLILLDVMMPGLSGYQVCERLKADPDTRAIPVIFVTAMSETADEQRGLELGAVDYITKPISPPIALARVRTHLALHRQRQELARQVEQRTAELLRTRQQIVRRLSRAAEFRDNETGNHIVRMSHIARLIAQAAGMGAEFVETLFNAAPMHDIGKIGIPDSILFKSGRLEPEEWAIMRRHTEIGAKIIGRHDDDLLKAAHSIALHHHEKWDGSGYPQGLGGEEIPLMARIAAVADVFDALTSARPYKKAWPLEEAVGYIEAQAGTHFDPALIGPFRRSLGEIARIVERYADHQGPCLDFDP

SEQ ID NO: 9532 - protein, 134 aa, Brucella suis 1330
MLERLNHVAIAVPDLEAATALYRGKLGATVTEPEARPEHGVTVVFIDVGNTKIELLEPLGEGSPIAAFLEKNPSGGMHHLCYEVADIIAARDRLKAEGARILGNGEPKIGAHGKPVLFLHPKDFNGTLIELEEV

SEQ ID NO: 9533 - protein, 134 aa, Nitrobacter winogradskyi Nb-255
MLGRLNHVAIAVRDAEKAAKIYGAAFGAEISAPLPLPEHGVITVFAILPNTKIEFIQPLGETSPIAKFVERNADGGIHHVCYEVPDIVATRDILIAEGARVLGDGEPKIGAHGKPVLFFHPKDFSGALVEIEQS

SEQ ID NO: 9534 - protein, 134 aa, Rhodopseudomonas palustris HaA2
MLGRLNHVAIAVKDAEQAAKIYGAAFQAEISEAVPLPEHGVITVFVTLPNTKIEFIQPLGEASPIAKFLDRNADGGIHHVCYEVPDIIAARDTLIKEGARVLGDGQPKIGAHGKPVLFLHPKDFSGALVEIEQS

SEQ ID NO: 9535 - protein, 134 aa, Rhodopseudomonas palustris BisB18
MLGRLNHVAIAVKDAEKAAKIYGAAFGAEISAAVPLPDHGVITVFVSLPNTKVEFLQPLGESSPIAKFLERNADGGIHHLCYEVADIIATRDLLIGEGARVLGDGTPKIGAHGKPVLFLHPKDFSGALVEIEQA

SEQ ID NO: 9536 - protein, 134 aa, Rhodopseudomonas palustris BisB5
MLGRLNHVAIAVKDAEQAAKIYGAAFNAEISAAVPLPDHGVITVFVTLPNTKIEFIQPLGEASPIAKFLERNADGGIHHVCYEVPDIIAARDTLIKEGASVLGDGQPKIGAHGKPVLFLHPKDFSGALVEIEQS

SEQ ID NO: 9537 - protein, 134 aa, Nitrobacter hamburgensis X14
MLGRLNHVAIAVRDAEKAAKIYGAAFGADISAAVPLPEHGVITVFAALPNTKIEFIQPLGEASPIAKFIERNADGGIHHICYEVPDIVATRDILIAEGARVLGDGEPKIGAHGKPVLFFHPKDFSGALVEIEQS

SEQ ID NO: 9538 - protein, 134 aa, Rhodospirillum rubrum ATCC 11170
MIGRLNHVAIAVPDLEAACAVYRDALGATVSAPLPQPDHGVTVVFVELPNTKIELLHPLGEASPIAAFLSKSPAGGIHHICYEVEDILAARDHMKAEGKRVLGDGEPRLGAHGKPVLFLHPKDFNGTLVELEQA

SEQ ID NO: 9539 - protein, 134 aa, Mesorhizobium BNC1
MLKRLNHVAIAVPDLEAAAATYRDVLGATVSPPQALPEHGVTVVFVELGNTKVELIEPLGENSPIAGFLEKSPAGGMHHICYEVDDIIVARDRLVAGGARVLGDGEPKTGAHGKPVLFLHPKDFCGTLVELEEV

SEQ ID NO: 9540 - protein, 139 aa, Maricaulis maris MCS10
MKIGRLNHVGVAVPDIEAAKKTYAALYGATQATETKDFPHLGVRVAFVHLDNSEIELIEPCGEASPIHKFLERNPKGGQHHICFEVPDIIAARDAMRERGATVLGTGEPYIGAHCVPVIFVHPKDSHGQLIELMQEPAR

SEQ ID NO: 9541 - protein, 134 aa, Bradyrhizobium BTAi1
MLGRLNHVAIAVKDAEKAAKIYGAAFGAEISSAVPLPEHGVITVFVTLPNTKIEFIQPLGEASPIAKFLERNADGGIHHVCYEVADIIASRDTLIKEGARVLGDGQPKIGAHGKPVLFLHPKDFSGALVEIEQA

SEQ ID NO: 9542 - protein, 134 aa, Brucella ovis
MLERLNHVAIAVPDLEAATALYRGKLGATVTEPEALPEHGVTVVFIDVGNTKIELLEPLGEGSPIAAFLEKNPSGGMHHLCYEVADIIAARDRLKAEGARILGNGEPKIGAHGKPVLFLHPKDFNGTLIELEEV

SEQ ID NO: 9543 - protein, 134 aa, Sinorhizobium medicae WSM419
MLGKVNHVAIAVPDLSAAVESYRSTLGALVTEPQALPEHGVTVVFVALPNTKVELLEPLGDASPVSAFLEKNPAGGMHHICYEVEDIIAARDRLKDAGARILGDGNPKIGAHGKPVLFLHPKDFQGTLIELEQV

SEQ ID NO: 9544 - protein, 134 aa, Ochrobactrum anthropi ATCC 49188
MLERLNHVAIAVPDIDAAAALYRGKLGAKVTEPQALPEHGVTVVFIDVGNTKIELLEPLGEGSPIAAFLEKNPSGGMHHLCYEVADIIAARDRLKAEGARILGDGEPKTGAHGKPVLFLHPKDFNGTLIELEEV

SEQ ID NO: 9545 - protein, 134 aa, Parvibaculum lavamentivorans DS-1
MLGPLNHVAIAVPDVRAAGEMYRTKFAAKVSDAVPQPDHGVTTVFVDLGNTKIELLEPLGENSPIAGFLAKNPKGGIHHICIEVEDIDSACEKMNTEGVTITGTGKPRIGAHGKPVVFLHPKDLYGTLVELEQA

SEQ ID NO: 9546 - protein, 134 aa, Xanthobacter autotrophicus Py2
MIGRLNHVAIAVRDIAAASALYRDTLGADVSAAVPQPEHGVTTVFVTLPNTKIEFLEPLGENSPIAKFLERNPDGGIHHICYEVDDILTARDQLKATGARVLGSGDPKIGAHGKPVLFLHPKDFNGTLVELEQA

SEQ ID NO: 9547 - protein, 134 aa, Methylobacterium extorquens PA1
MIGRLNHVAIAVKDLDAATAVYRDTLGAKVTEPLPQPEHGVTVVFVELPNSKVELMSPLGENSTIQGFVDKNPAGGIHHVCYEVEDIIAARDQMKAAGARVLGTGEPRIGAHGKPVIFLHPKDFLGTLVELEQV

SEQ ID NO: 9548 - protein, 134 aa, Methylobacterium radiotolerans JCM 2831
MIGRLNHVAIAVQDLDAACAVYRDTLGAKITAPLPQPEHGVTVVFVELPNSKIELMAPLGEGSPIESFVARNPGGGIHHVCYEVDDILAARDKLKAQGARVLGTGEPRIGAHGKPVLFLHPKDFLGTLVELEQV

SEQ ID NO: 9549 - protein, 134 aa, Methylobacterium populi BJ001
MIGRLNHVAIAVKDLDAATAIYRDTLGAKVTEPLPQPEHGVTVVFVELPNSKVELMSPLGENSTIQGFVDKNPAGGIHHVCYEVEDIIAARDKMKAAGARVLGTGEPKIGAHGKPVIFLHPKDFLGTLVELEQV

SEQ ID NO: 9550 - protein, 134 aa, Rhodopseudomonas palustris TIE 1
MLGRLNHVAIAVKDAVQAAKVYGAGFDAAISEAVPLPEHGVITVFVTLPNTKIEFIQPLGEASPIAKFLERNADGGIHHVCYEVPDIIEARDRLTKEGARVLGDGNPKIGAHGKPVLFFHPKDFSGALVEIEQA

SEQ ID NO: 9551 - protein, 134 aa, Methylobacterium sp. 4-46
MIGRLNHVAIAVKDLDAAAKVYRDTLGAALSPPLAQPEHGVTVIFVELPNSKIELLEPLGADSPIAAFLERNPGGGIHHVCYEVDDILAARDRLKGEGARILGSGEPRIGAHGKPVLFLHPKDFLGTLVELEQA

SEQ ID NO: 9552 - protein, 134 aa, Rhizobium leguminosarum bv  trifolii WSM2304
MLGRVNHIAIAVPDLAAATAAYRDTLGAAVSQPQALPEHGVTVVFVELPNTKVELLQPLGETSPIATFLEKNPSGGMHHICYEVDDILLARDRLVAAGARVLGDGQPKTGAHGKPVLFLHPKDFFGTLIELEQA

SEQ ID NO: 9553 - protein, 134 aa, Methylocella silvestris BL2
MIGRLNHVAIAVKELAPAAAQYRNALGAKVSEPEPLPDHGVTVVFITLDNAKIELLEPLGEASPIADFVARNPKGAIHHICYEVDDIVAARDRLHASGARVLGGGEPKIGAHGKPVLFLHPGDFSGTLIELEQA

SEQ ID NO: 9554 - protein, 134 aa, Methylobacterium chloromethanicum CM4; identical to SEQ ID NO: 9547

SEQ ID NO: 9555 - protein, 134 aa, Methylobacterium nodulans ORS 2060
MIGRLNHVAIAVKDLEAAAKIYRDTLGATLSPPLAQPEHGVTVIFVELPNSKIELLEPLGADSPIASFLERNPGGGIHHVCYEVDDILAARDRLKGEGARILGSGEPRIGAHGKPVLFLHPKDFLGTLVELEQA

SEQ ID NO: 9556 - protein, 134 aa, Agrobacterium vitis S4
MLGRVNHIAIAVPDLSSAVETYADTLGATVSEAQALPEHGVTVVFVELPNTKVELLAPLGDHSPIKAFLEKSPNGGMHHICYEVDDIYAARDRLISKGARVLGDGEPKIGAHGKPVVFLHPKDFNGTLIELEQL

SEQ ID NO: 9557 - protein, 134 aa, Rhizobium leguminosarum bv  trifolii WSM1325
MLGRVNHIAIAVPDLAAATAAYRDTLGAAVSQPQTLPEHGVTVVFVELPNTKVELLQPFGDTSPIAAFLEKNPSGGMHHICYEVDDILLARDRLVAAGARVLGDGQPKIGAHGKPVLFLHPKDFFGTLIELEQA

SEQ ID NO: 9558 - protein, 170 aa, Prochlorococcus marinus NATL2A
MKIPKYIEFHNRTNSVLSRFLKAAEPEEGCCILIGKTNSLTKDHKRNIWEVTHVWNCQNIWGEEESRLIDQNIEAVSNQKNLQLSKKNCFEIYAKDQIASQKWARENDLEVLCCAHSHPLNENRPSEMDLLFHQPPGLMVISNKDGDLKAWWIKNKLKFHSVKIEVFSLT

SEQ ID NO: 9559 - protein, 165 aa, Anabaena variabilis ATCC 29413
MNQPTIKLLPQHQQTILSHAESVYPEECCGLIMGYVANKAKIVVEVIPTANAWETEADNFTQEINQTNITSPASTLKRRYAIAPQVMLQVQRQARDKSLNIIGIYHSHPDHHAVPSECDRLYAWPGYSYIIVSVQKGIASGILSWSLDDHHQFQSEIIDNITLNT

SEQ ID NO: 9560 - protein, 134 aa, Nitrosococcus oceani ATCC 19707
MAEVILPRPLVNQLLHQAQVKPQQEICGLISARNGLPSRCYPINNIAPEPQRHFFMDPQGQIAAMRRMREEGEELFGIYHSHPETAPLPSKSDLAQAAYPGALYLIISLNTKGVLEMRGFRLQGEVYEEIELQL

SEQ ID NO: 9561 - protein, 184 aa, Synechococcus sp. CC9902
MGSVEFLTHSAERIGGEPFAPSLLGLDLQCLTVLERSLLAVKPQEGCGLLLGTGLRTPRLRLVTLWPACNAWKKSDWVNDALGDLETRFVLDPREQIAAQRWARVHGLEVLGVCHSHPKTAPEPSTRDCAWAEPNQLMLILSGMRELRAWWLGADRHPLEIPIEVWENHTYAAKSSHPKSEPVL

SEQ ID NO: 9562 - protein, 150 aa, Synechococcus sp. CC9605
MLQIDHRCHTDLRRILLAPHPEEGCALLLGQRTNSGCLRVTTTWPCCNVWGRGASGQRPVHDRCRRFLVDPREQLAAQRWARNRHQYCLGVAHSHPASEPVPSPHDRQWGEAESVMLILSASLGLRAWWLHGDRSVDEIPIQLWDTHKNA

SEQ ID NO: 9563 - protein, 132 aa, Geobacter metallireducens GS-15
MLTIPRAIHAELIAHAQADAPIEACGILGGIDGAVSAIFRMANTDQSDEHFMMDPKEQFAVVKELRNRGLAMLAIYHSHPETPARPSEEDIRLALTPGVSYVIASLAGAEPDVKAFRITDGVVEPEPIDIVE

SEQ ID NO: 9564 - protein, 144 aa, Synechococcus elongatus PCC 7942
MLTLLLPATCRHTIAVHLQQCYPQEGCGLLLGVDRRVEQVWPATNVWQPEDTDEDHDRCDRYQVDPQALLQAQRYCRDRQWQILGIYHSHPDHPAVPSECDRQQAWPEYVYLIASVTQGKIEDCRCWHLNDQRQFEAIAIAEPT

SEQ ID NO: 9565 - protein, 159 aa, Nitrosospira multiformis ATCC 25196
MSTSWRIRIMLTIHAKLVEAMLAQAHKDHPFEICGVIAGPEKSNLPLRLIPMRNAAQSETFFKFDPQEQLQVWREMEARGEEPIVIYHSHTHTPAYPSRTDVQYASQPQSHYVIVPTDPAYGEEIRSFRILDGMVTEERIRMINSYKAEWELSMEAMVA

SEQ ID NO: 9566 - protein, 155 aa, Trichodesmium erythraeum IMS101
MPLILSSSYFQKILTHAEISYPNECCGLLLGQKNQETKTVIEVWPAENAWQTEADEYWPEQTEFTEEKRYAISPELMLKTMKSARERHLSIIGIYHSHPNHVAIPSEFDRTYAWPEYSYVIISVEKGQAIDFLCWSLDDNHQFQPEKIIKIKDKQ

SEQ ID NO: 9567 - protein, 142 aa, Alkalilimnicola ehrlichei MLHE-1
MMAPLSPHALTLPARERDRLARLGLARWPEEACGLMLGCDGRVRRLVLCRNVAARRADRYLVHARDFLRWDRAAHRLGLDILGVWHTHPDGGARPSGTDREQAWRGWSYLIAAVDGRAITELRSWRLRGDHFIEETLCLKPA

SEQ ID NO: 9568 - protein, 167 aa, Prochlorococcus marinus MIT 9303
MPGLLEFDRNCLMVLRRSLLAVAPFEGCALLLGDQDDSNSDQGGSIWNVRLIWPCCNVWGPGMLSLPEGSNDPNLGVELLPSRKCRFALDPREQLQAQRFAREHNWQVLGSAHSHPGGEAVPSVMDHRWATVPSLLVIVAGSGNVRAWWLTGVQPGEQHEVAHLGQW

SEQ ID NO: 9569 - protein, 170 aa, Prochlorococcus marinus NATL1A
MKIPKYIEFHNRTNSVLSRFLKAAEPEEGCCILIGKTNSSTKDHKRNIWEVTHIWNCQNIWGEEESRLIDQNIEAVSIQKNMKLSKKNCFEIDAKDQIASHKWARENDLEVLCCAHSHPLNENKPSEMDLLFHQPPGLMVISNKDGDLKAWWIKNKLKFHSVKIEVFSLT

SEQ ID NO: 9570 - protein, 139 aa, Clostridium thermocellum ATCC 27405
MIVMTKQQYQEILEHSRNALPNEACGLLGGRIENGVKYVEKVYLLRNIDESPEHFSMNPKEQFAAVKDMRNNGWELLGNFHSHPATPSRPSEEDIRLAFDPKASYLILSLKDDTPVLKSFNISSGQATQEELSIVGEEA

SEQ ID NO: 9571 - protein, 132 aa, Geobacter uraniumreducens Rf4
MLKISKAIHDDIIAHAREGFPLEVCGILGGRDGVVSAIYRMTNTDQSNEHFMMEPKEQFAVVKGLRASGLEMLAIYHSHPETPARPSEEDIRLALTPNVSYVIVSLAEPERPVLNSFRIAAGRGEPEAVGVV

SEQ ID NO: 9572 - protein, 164 aa, Prochlorococcus marinus MIT 9211
MNLPTVIKFHGHSKEVLIKSLLIKFPQEGCALLLGKKKKETNLSKNFFYEISLIWPCCNIWEPEMKSFSEECLKEDLTQKPPSKTNRFAIDPKEQISAQKWARKKNLSLLGSAHSHSYSCANPSRLDLSWNFSPGLMIIVDGSGVIRAWWIGASKTIEPTEIPI

SEQ ID NO: 9573 - protein, 156 aa, Natranaerobius thermophilus JW NM WN LF
MKIWILQTEYQKMLEHAKKEFPLECCGLMAGFKKPKGYVITNIYEMTNMEQSSTKYSLDPQEQFSVIKDIRNHGLELVGNYHSHPFTGCRLSDEDFRLAYDNDLVYAIISLKGELPVLKFFLIKENLKNASQELNVQLLVSKDQVINSNTTDEGGL

SEQ ID NO: 9574 - protein, 146 aa, Chlorobium phaeobacteroides BS1
MEMCKSVYEKIIEHARRETPLEACGYLGGKGKTVIEAYCLTNIDQSREHFSFDPKEQFNAVLTMRSKKQLAVAVYHSHPVTPARPSQEDIRLAFDPEIINVIVSLAAQEPEVNAFRIVKGDVTEEPLVVIEGLCEEPENRERRNGT

SEQ ID NO: 9575 - protein, 133 aa, Geobacter bemidjiensis Bem
MVEIPKEILAAVISHAQNGFPLEVCGILGGNGQVVASHHPMTNTDASNDHFMMDPKEQFAVVKALRASGEEMLVIYHSHPESPARPSQEDIRLALTPNVHHLIVSLEARDKPVAKAFRIEGGAVEPVEIVVAG

SEQ ID NO: 9576 - protein, 138 aa, Desulfitobacterium hafniense DCB 2
MITLTKKQMEEMLAHARQALPNEACGLLGGRRDGDDRWVERVYPLNNLDQSPEHFSMDPREQLTAVKDMRKNGWVMLGNFHSHPATPARPSAEDKRLAFDPSLSYLIISLAEPQKPVCKSFLIKKDGVDEEEIILKEE

SEQ ID NO: 9577 - protein, 136 aa, Anaerocellum thermophilum DSM 6725
MIILPKTLYEEMLNHCLNSLPIEACGLLGGVIEDEKRIVKKVYLLTNVDQSSEHFSMDPLEQFAAVKDMRKNGWVLLGNFHSHPTSPSRPSEEDKRLAFDRDLSYLILSLMDEKNPVLKSFRIYESYVEEEEIQII

SEQ ID NO: 9578 - protein, 133 aa, Geobacter M21
MVEIPKEILAAVISHTQSGFPLEVCGILGGKGQVVASHHPMTNTDASNDHFMMDPKEQFAVVKALRAIGEEMLVIYHSHPESPARPSREDIRLALTPNVHHLIVSLEARDKPVAKAFRIEGGAVEPAEIVVAG

SEQ ID NO: 9579 - protein, 136 aa, Candidatus Methanosphaerula palustris E1 9c
MILQPDIMESLFTQAEYEAPIEACGYLAGTDGQITRHFPLTNIDGKEDHFSFDPQEQFATLKAARQEGLSIIGMYHSHPASPARPSPEDVRLAYDPTIVYIIISLMNDTRTVRGFYIRKGEVVEEPLTIGENTNDQ

SEQ ID NO: 9580 - protein, 93 aa, Bacillus cereus ATCC 10987
MIIASLSFECMIYDVHSLKEKRAILQRVLTRVKQRYNVAVSEVGHQDVWQRTEIAIVSVSSNRVICEKEMNRVLEYIDSFPEIERTITQLEWY

SEQ ID NO: 9581 - protein, 92 aa, Listeria monocytogenes 4b F2365
MIQSVVSEFFMQEPQNLKEKRAILKRIVTRAKQKFNISIAETDYQDLWQRAEISFAIVSSSHIQAEKEAREVLAFLDSFPEWERAETVMEKL

SEQ ID NO: 9582 - protein, 93 aa, Bacillus anthracis Ames 0581; identical to SEQ ID NO: 9580

SEQ ID NO: 9583 - protein, 93 aa, Bacillus anthracis str Sterne; identical to SEQ ID NO: 9580

SEQ ID NO: 9584 - protein, 93 aa, Bacillus thuringiensis konkukian; identical to SEQ ID NO: 9580

SEQ ID NO: 9585 - protein, 93 aa, Bacillus cereus ZK; identical to SEQ ID NO: 9580

SEQ ID NO: 9586 - protein, 97 aa, Thermobifida fusca YX
MYVGALTLDLLLGDVRSLKQKRSVIRPIVAELQRKYSVSVAETGNHDLYRRCEIGIAVAASTAAHCTALMNSCERLVADRPEVELLSARQRLFNDEE

SEQ ID NO: 9587 - protein, 95 aa, Pelobacter carbinolicus
MVVGVMQVELFIHGAQNLKAKRAVVKSLIGRCRARFPVSCAEVGHRDLWQRTTIGFTIVEKDEASADRILQKVIVELERSSLAEIIRQDMELIHY

SEQ ID NO: 9588 - protein, 151 aa, Anaeromyxobacter dehalogenans 2CP-C
MFVGVLRLTLHLPEPGSLKSKRHLIRSALDRVRAKFNVSISEVAENDLWQRSVVGVAAVGNEHAFVNEVLDKVADFVGSMHGGQILVTARDIEIVPYGDGIGEGTTRTLAEAEGAPSWGDEGAREQEPRFPRPRPRPRDEDEHQDEGDDEP

SEQ ID NO: 9589 - protein, 132 aa, Frankia CcI3
MWIGTLSLDLLLGDVHSLKEKRSVVRPIVAELRRRFALSVAETGHHDLHRRAEIGMAVVAADRAHCVEVLCSCEHLVAQRPDVEVLAARARYFSADDADDEPHAPGEPHAPGASAAVSVPPAGPANEEVDGG

SEQ ID NO: 9590 - protein, 96 aa, Candidatus Koribacter versatilis Ellin345
MAIAYLTLELRMETAHSLKDKRQVVRSLKDKLRASFNVSVAEIENLDLWQLATIGVVSVSDSRDYLEGLMRNVESAATRIANNAGADVTDSFLDFV

SEQ ID NO: 9591 - protein, 93 aa, Rubrobacter xylanophilus DSM 9941
MFCTIRLELELPYASSLKDKRQTLRSLKDRLRRRNVSVAECDNHDFWQRATLELAVAAVSRGAAEEKREEVRRMLLNYEELAILEWYEEFVKL

SEQ ID NO: 9592 - protein, 90 aa, Syntrophobacter fumaroxidans MPOB
MVFRLHGNQSLKDKRSVVKSLVEKSRHRFNVSVAEVADQDLHQKATIGIAVIGSDGRVINSVLDRIMAFMESLGLAELVAQEIELIPLGE

SEQ ID NO: 9593 - protein, 99 aa, Acidothermus cellulolyticus 11B
MFTGILTLDLRLGDVHSLKEKRGVVRPILAEVRRRFEVAVAEVGHLDLHRRSLIGVAVIAADAAHCRHVLEACERWVADRPDVELLSAHQRLVGEEDDE

SEQ ID NO: 9594 - protein, 96 aa, Desulfovibrio vulgaris DP4
MVLGVLTVEYRLHGNDSLKGKRRIANSLKQKVRNTFNVAIAEVETEDSLTMLRLAVVSVSNSHQHLQSRLDKCLAMMEAVCPEEMVYSDIEIFAAD

SEQ ID NO: 9595 - protein, 93 aa, Bacillus cereus cytotoxis NVH 391-98
MIIASLSFECIIYDVHSLKEKRAILQRVLTRVKQRHNVAVSEVGHQDVWQRAEIAIVSVSSNRVVCEKEMNRVLEYIDSFPEIERTITHLEWY

SEQ ID NO: 9596 - protein, 109 aa, Frankia EAN1pec
MWIGSLTLDILLGDIHSLKEKRSVVRPVVAELRRRFAVSAAETGGLDLHRRVEIGVAVVAADRAHCAAVLGACEELVARRPELEILSARVRYLSEDDADDMTHPEVILP

SEQ ID NO: 9597 - protein, 104 aa, Candidatus Desulfococcus oleovorans Hxd3
MERTMEQGSMVAGLGLIVLHIDGCRSLKEKRAVVKAMIARLRNAFNASVAEVGLNDLHRSAHIGIALVGNDVSVVNARMDQMFNAADQMGQGRVIDTQMEIFTI

SEQ ID NO: 9598 - protein, 99 aa, Salinispora arenicola CNS-205
MTMFTGTAVFDLLLPGDSRSLKAKRSYVRPIVAALRRLEVSTAEVGALDRYGRSEIGVAVVAATAAHVGEVLDSCERVVAARPEVELLSVRRRLFGADD

SEQ ID NO: 9599 - protein, 93 aa, Bacillus weihenstephanensis KBAB4
MIIASLSFECMIYDVHSLKEKRAILQRVLTRVKQRYNVAVSEVGHQDVWQRTEIAIVSVSSNRVVCEKEMNRVLEYIDSFPEIERTITHLEWY

SEQ ID NO: 9600 - protein, 93 aa, Bacillus cereus AH187; identical to SEQ ID NO: 9580

SEQ ID NO: 9601 - protein, 93 aa, Dictyoglomus turgidum DSM 6724
MLIGVCRVIISIPDSFSLKEKRKVKRSIVDRVRAKFNVSIAEVDSQEIWNELVLGISMVSTESKHIYEVMSEIIKLIEEQKEAELIDYEIDIL

SEQ ID NO: 9602 - protein, 93 aa, Bacillus cereus B4264
MIIASLSFECMIYDVHSLKEKRAILQRVLTRVKQRYNVAVSEVGHQDVWQRTEIAIVSVSSNRVICEKEMNRVLEYIDSFPEIERTITHLEWY

SEQ ID NO: 9603 - protein, 93 aa, Bacillus cereus G9842
MIVASLSFECMIYDVHSLKEKRAILQRVLTRVKQRYNVAVSEVGHQDVWQRTEIAIVSVSSNRVICEKEMNRVLEYIDSFPEIERTITQLEWY

SEQ ID NO: 9604 - protein, 102 aa, Desulfovibrio vulgaris  Miyazaki F
MLRGTPMIIGVLTVEFELHGNDSLKGKRRIASSLKTKVRNTFNVSIAEVRNQDSLTRLSLAVVSVSNSERHLQSRLDKCLAMMEAVCPEEMTYSDIEFFAAE

SEQ ID NO: 9605 - protein, 151 aa, Anaeromyxobacter dehalogenans 2CP 1
MFVGVLRLTLHLPEPGSLKSKRHLIRSALDRVRAKFNVSISEVAENDLWQRSVVGVAAVGNEHGFVNEVLDKVADFVGSMHGGQILVTARDIEIVPYGDGIGEGAMRTLAEAEGAPSWGDEDAREQEPRFPRPRPRPREDDEHQDEGDDEP

SEQ ID NO: 9606 - protein, 98 aa, Actinosynnema mirum DSM 43827
MYVGALELDLLLGDVHSLKQKRSVVRPVVAELKRKFEVSASEAGHLDLHRRALIGVAVVAADAEHVRDVLAACERLVAGRPELELLSARHRLVGPEDV

SEQ ID NO: 9607 - protein, 95 aa, Desulfomicrobium baculatum DSM 4028
MIIGTLRLEFRLHGVFSLKEKRKSANSLKQKLRNTFNVSVAETEAQDSHQVLVLGVVTVSNDTAHVHSRLSKVLAMVEASTADELVHADMNVFGA

SEQ ID NO: 9608 - protein, 92 aa, Geobacillus WCH70
MIGFVACECVIYDAQSLKEKRAVLQRIMTRLKQKYNISIAEIDHQNVWQRTTLGIVAITSNRVTTERELQRALALIDSFPELERTVTTFEWF

SEQ ID NO: 9609 - protein, 93 aa, Catenulispora acidiphila DSM 44928
MTLDILLGDVRSLKEKRGIVKPILAELDKRAGVGAAETGHLDLHRRAEIGVAVVAATAARVKEVLDDLEGTVAWRPEIELLSVRRRLRSDEDD

SEQ ID NO: 9610 - protein, 97 aa, Saccharomonospora viridis DSM 43017
MFVGTLELDVLLGDVRSRKQKRSVVRPIIAELRKRYEVAVAETGHLDLYRRSLLGVATVAVDGAHVRDILDSCERLVAERPEIELLSAHRRLFGPDD

SEQ ID NO: 9611 - protein, 95 aa, Desulfohalobium retbaense DSM 5692
MHIGLLSIEFYLHGIGSLKDKRRIANSLKQKLRNKFNVAVAEIDTQHSHTWLKLEILTLANERARVESVLNKALAMVEAISDEEITDVHTDIFGV

SEQ ID NO: 9612 - protein, 104 aa, Nakamurella multipartita DSM 44233
MINRDGAVYVGVLECDVLLGAVGSLKQKRAIIRPVLARLRRLDVAATEAGDPDRHRRALIAIATVAGDPAAVQRVLDTCERQIVGEVEFEVLSTRRRVVGAHDE

SEQ ID NO: 9613 - protein, 135 aa, Nitrobacter winogradskyi Nb-255
MDMALSATDIIERLDLQPHPEGGHYRETFRDTRTDGHGRAASTAIYFLLARGERSQRHRIDAVEVWHYYAGSPLLLRIEDGAVTRTLRLGADLAAGETPQALVPAFAWQSAESTGDWTLVGCTVAPGFEFSGFEL

SEQ ID NO: 9614 - protein, 145 aa, Rhodopseudomonas palustris HaA2
MRATLSAAEVIAQLGLAPHPEGGHYRETFRDSRCDSTGRSASTAIYFLLARGERSHWHRIDAVEIWHYYAGATLTLEIADDNGHRAVALGPDVAAGETPQAIVPPQAWQAAVSTGDWTLVGCTVAPGFQFEHFELAPSGWSPRPG

SEQ ID NO: 9615 - protein, 147 aa, Rhodopseudomonas palustris BisB18
MPPAHDLTAAEIIARLELAPHPEGGHFRETFRDARVDPAGRAASTAIYFLLAKGERSHWHRIDAVEVWHYYAGAPLELQIADAEGRRTLRLGPDLAAGQLPQGLVPPHAWQAAQSSGDWTLVGCTVAPGFDFATFELAEKGWEPAAR

SEQ ID NO: 9616 - protein, 142 aa, Rhodopseudomonas palustris BisB5
MPSAAEMIARLKLQPHPEGGHFRETFRDPRCDASGRSFSTAIYFLLASGERSHWHRIDAIEVWHYYAGAALALEIADADGHRAIRLGPDVAAGEQPQAIVPPHAWQAAVTTGDWTLVGCTVAPGFAFEHFELAPPDWSPLRR

SEQ ID NO: 9617 - protein, 136 aa, Nitrobacter hamburgensis X14
MDMALSAADIIARLGLKPHPEGGHYRETFRDVRTDDQGRAASTAIYFLLARGERSRRHRIDAVEVWHYYAGSPLLLQIDDGAIMRTICLGANLAAGEVPQALVPAYAWQTAQSSGDWTLVGCTVAPGFEFSGFELG

SEQ ID NO: 9618 - protein, 150 aa, Maricaulis maris MCS10
MSAPEPALPDDARRIVDTLGMQPHPEGGWYVETLRDPDPAGGRDRSTAIYYLLATGEHSHWHRVDAVEIWHWHAGSPLDLGVSVDGQSATTLLLGPDLANGQLPQGIVPEGAWQSARSTGQWTLVGCTVAPGFHFEGFELAPPDWSPGQG

SEQ ID NO: 9619 - protein, 112 aa, Bradyrhizobium BTAi1
MNAAGRAASTLIYFLLARGERSHWHRVDAVETWHFYAGAPLTLRIAAAGQPPRTTTLGIDLAGGQEPQAVVPAHAWQAAESTGDWTLVGCTVAPGFEFAGFELAPQGWEPSM

SEQ ID NO: 9620 - protein, 154 aa, Sinorhizobium medicae WSM419
MTTREMTAAAIIETLRLARHPEGGWYGETFRDADGGPRGHSTAIYYLLERGDRSHWHRVRDAAEVWHYYAGAPLELSIGEPGRPPSQVRLGSDIPAGERPQHVVPANWWQSAASLGDWTLVGCTVAPGFDFTVFEMAPPEWQPPDAHKGAQVNG

SEQ ID NO: 9621 - protein, 144 aa, Parvibaculum lavamentivorans DS-1
MTLDTGLDADGIIELLQLKPHPEGGYFAETFRDPAGGTRAYSTAIYYLLKEGERSHWHRVDAAEIWHWYGGGPLALSFYEEGREAETRILGSNLDAGERPQLVVPAGIWQAAEPLGLWTLVGCTVAPGFEFGGFEMAEPGWQPG

SEQ ID NO: 9622 - protein, 154 aa, Xanthobacter autotrophicus Py2
MADGLNGLTAEEVVALLQLQPHPEGGHFRETFRDRPAGRDAAGGARGASTAIYFLLKEGQRSHWHRVDAAEIWHWHAGAPLTLAIADGEGRRELALGPDLKAGERPQAVVPPFAWQAAQSRGAWTLVGCTVAPAFQFEGFELAPPGWEPDEGPA

SEQ ID NO: 9623 - protein, 154 aa, Caulobacter K31
MTFMGSGKAISGDLGGKEIIRLLDLQPHPEGGWYRRTFEDEAQVDGRPASTAIYYLLQAEEMSAWHRIDAVEIWHFHAGAPLSLTLSPPDGRGATAHTLGSDLRAGCRPQVVVPTGWWQTAVSLGAWSLVGCTVAPGFRFEGFELAPEGWRPTV

SEQ ID NO: 9624 - protein, 144 aa, Beijerinckia indica ATCC 9039
MILADRTAQDIITALALKPHPEGGHFRETFRDPRSDAEGRSFSTLIYFLLAAGETSAWHRIDAAEVWHFYAGAPLDLRITEAGKSTSHRLGADVLNGEEPQIVVPALAWQSARSLGAWTLIGCSVAPAFQFSTFEMAPAGWQPD

SEQ ID NO: 9625 - protein, 133 aa, Rhodopseudomonas palustris TIE 1
MRLGLQPHPEGGHYRETFRDPRCDASGRSYSTAIHFLLRAGERSHWHRIDAVEVWHYYAGAALMLEVAGEDGHRAATLGPDLVAGHLPQVIVPPQAWQAATSTGEWTLVGCTVAPGFDFAGFELAPPGWEPAR

SEQ ID NO: 9626 - protein, 147 aa, Methylobacterium sp. 4-46
MTASSLTAAEVIRLLDLKPHPEGGHYRETFRDPHQIEGRAASTAIYYLLDVGETSEWHRVDAAELWFWHAGAPLVLTVSPNGHDAEAVHLGPDLAHRQRPQAVVPAGHWQTATSLGAWTLVSCTVAPGFRFEGFEMAPKDWRPLPRR

SEQ ID NO: 9627 - protein, 140 aa, Rhizobium leguminosarum bv  trifolii WSM2304
MSPEDIIRELGMQPHPEGGWYVQTFRDTAGGDRGHSTAIYYLLTRGQRSHWHRVHDAVEVWHYYAGAPLALQRSEDGTASETLTLGTNLSDGERPQAIVPANWWQAAESLGEFTLVGCTVSPGFEFSSFEMAQAGWTPGG

SEQ ID NO: 9628 - protein, 155 aa, Methylocella silvestris BL2
MSGPPPSDCEAASADEIIARLELAPHPEGGWYKETFRDQATDASGRAASTLIYFLLREGERSNWHRIDAAEIWHFYAGAPLALSLSQSGETVDRHILGRELLKGERPQLIAPAGWWQSAASLGRWTLVGCSVAPGFEFSRFELAPAGWRPAAGEG

SEQ ID NO: 9629 - protein, 148 aa, Methylobacterium nodulans ORS 2060
MTSSPSLTAAEVVRLLDLKPHPEGGHFRETFRDPREIDGRAASTAIYYLLDVGETSEWHRVDAAEIWLWHAGAPLVLTVSPNGHDAEARHLGPDLARGQRPQIVVPAGHWQTATSLGAWTLVSCTVAPGFRFEGFELAPPNWRPMPRG

SEQ ID NO: 9630 - protein, 143 aa, Agrobacterium vitis S4
MADADEIIAALAMQPHPEGGWYSETFRDGAGGARGHSTAIYYLLKAGQRSHWHRVKDAAEVWHYYAGAPLALYRSNDGQSVETLVLGRDLVRGERPQAIIPALSWQAAESLGEYTLVGCTVAPGFTFDAFEMAPPDWEPGQPL

SEQ ID NO: 9631 - protein, 140 aa, Rhizobium leguminosarum bv  trifolii WSM1325
MSPEDIIRELGMQPHPEGGWYVQTFRDTAGGERGHSTAIYYLLTRGQRSHWHRVHDAAEAWHYYAGAPLSLHRSEDGTASQTLTLGTNLSAGERPQAIIPANWWQSAETLGDFTLVGCTVSPGFEFSSFEMAPPGWKPGG

SEQ ID NO: 9632 - protein, 260 aa, Arthrobacter FB24
MNLTSSTSTNNTTPDIETFHGSSLELRNLTMAYGEVEVLRNVSLTVAPGTTTCIIGPSGSGKSTLLRGINRLHEPKSGDVLLAGQSALEVKPDTLRARIGMVFQHFNLFPDHTALENVALALWSVKGMPKAEARERARRRLAEVGLAERADHRPRDLSGGQQQRVAIARALAMEPEVMLFDEATSALDPELVKGVLNLMAGLGKRGMTMLVVTHEMGFARKVADQVVFMDEGEVVEAGTPAEIFDNPRSERLRRFLSEVL

SEQ ID NO: 9633 - protein, 241 aa, Shewanella baltica OS185
MIKITNLHKNFGDNKVLKGISEHIRQGEVVSVIGPSGSGKSTFLRCINLLEQPSQGDIEIEGQLITAPNACVDKLRQKVGMVFQNFNLFPHKTVIQNITLAPISLKLMTPAQAETKALDLLAQVGLSDKANAYPASLSGGQKQRVAIARALAMEPDLMLFDEPTSALDPEMVGDVLDVMKDLALKGMTMVIVTHEMGFARDVSDRVIFMDGGYVVESSPPDELFTNPKEARTQAFLSKVLR

SEQ ID NO: 9634 - protein, 240 aa, Bacillus cereus cytotoxis NVH 391-98
MIKIENLHKSFGEHKVLKGITTTIEKGEVVAIVGPSGSGKSTFLRCMNVLETPTSGSIWIGDKEVTNLKTNMMNVREKVGMVFQHFHLFPHMTVLENIIYAPVNVKGIAKGTAEQKAMELLEKVGLLNKKGAYPNRLSGGQKQRVAIARALAMEPEVMLFDEPTSALDPEMVKEVLEVMKSLVTTGMTMVIVTHEMGFAKEVADRVLFLDGGKLVEDTTPQQFFTEPKSDRAKVFLQKIL

SEQ ID NO: 9635 - protein, 242 aa, Campylobacter hominis ATCC BAA-381
MIEIQNLTKSYGSLLVLDNISKKIHNGNIVAIIGPSGGGKSTFLRCLNLLEIPDGGKIIINGEDITNKKTDINKVRQKVGMVFQHFNLFANKNVLENLTLAPIMTGILTHKEAYKKAESLLERVGLLDKINYFPHKLSGGQKQRIAIARSLMMNPDVILFDEPTSALDPEMIGEVLTLMKDVARDGLTMLVVTHEMGFARNVANRIFFMEKGKIAVDDTPKNVFENPQNTRLKEFLNKILNH

SEQ ID NO: 9636 - protein, 241 aa, Shewanella baltica OS195; identical to SEQ ID NO: 9633

SEQ ID NO: 9637 - protein, 247 aa, Clostridium phytofermentans ISDg
MTTDAQVIIKVENLHKAYNKVYALNGINEEIRKGEVVVIVGPSGSGKSTFLRSLNLLEVPTEGKIFFEGVDITDKATDINKHRQRMGMVFQHFNLFPHMTILKNLMIAPMKLQGKSEEEAKKKALELLDRVGLAHRADAYPSQLSGGQKQRIAIVRALAMDPEVMLFDEPTSALDPEMVGEVLDIMKELGREGMTMVVVTHEMGFAKEVADRVMFIDQGVVQEQNSPAEFFGNPQNQRLKDFLSKVL

SEQ ID NO: 9638 - protein, 241 aa, Shewanella baltica OS223
MIKITNLHKNFFDNLVLRGISEHIRQGEVVSVIGPSGSGKSTFLRCINLLEQPSQGDIEIEGQLITAPNASVDKLRQKVGMVFQNFNLFPHKTVIQNITLAPISLKLMTPAQAETKALDLLAQVGLSDKANAYPASLSGGQKQRVAIARALAMEPDLMLFDEPTSALDPEMVGDVLDVMKDLALKGMTMVIVTHEMGFARDVSDRVIFMDGGYVVESSPPDELFTNPKEARTQAFLSKVLR

SEQ ID NO: 9639 - protein, 252 aa, Catenulispora acidiphila DSM 44928
MSTEALDANALLRLRGVHKRFDDRTVLDSIDLDVAAHQVVCLIGGSGSGKSTLLRCVDLLVEVDDGTIHLGATELTDPALDQRLARRRIGVVFQAYNLFPHLSVLDNVALAPRRVLGRSRDQAESEAMALLTRLGLADKARDYPDRLSGGQQQRAAIARSLATEPEVLLFDEITSALDPELVGEVLDVVADLKDRGFTILMATHEMDFARHAADQVCFLDNGVIRERGEPDQILTEPREAATQRFLARLLNR

SEQ ID NO: 9640 - protein, 324 aa, Rhodoferax ferrireducens T118
MSSTILHTSGFTPSISSADQDSSPTFVNPAEGGGDGEKNPFLAALGERVRALRARRGMTRKALAMVADVSERHLANLEYGVGNASILVLLQVAGALQCSLGELIGDVTTSSPEWLMIRELLEQRDDATLQRVRIAIGEMLGTGGGNAGLSPRIALIGLRGAGKSTLGQMLADDLGFPFVELSREIEKFAGCSVSEIQALYGVSAYRRYERRALEEAIQIYPEAVIATPGGLVSDAATFNELLAHCTTVWLQADPEDHMKRVTAQGDLRPMAASKEAMEDLKGILHGRAPFYSKAQFKLDTSAQPLGPTFNALRDMVRKVLQLPA

SEQ ID NO: 9641 - protein, 327 aa, Burkholderia xenovorans LB400
MNQNYSPASLDDSADEDAGRAERATERGGEREERDPFLTAMGERVRLLRARRGMTRKTLATETGLSERHLANLESGVGNASVLVLRQIAATLNCSLAEVIGDETTASAEWLLIRELLHGRDQAALQRARMALAEMFAQAPRDPHRKDRIALIGLRGAGKSTLGRMLAQERKVPFVELTRVIEQLAGCPPSEIHSLYGAAAYRRYEHRALEAVIQEHEHAVIASPGGLVSESGTFNTLLSHCYTVWLQAAPEEHMRRVVAQGDLRPMSGNKEAMDDLKRILAGRSELYGRADMSFDTSEKTLADAYLQLRDRLAARLAAESPDEARVG

SEQ ID NO: 9642 - protein, 332 aa, Polaromonas JS666
MSSNILHQSGLTLSEVATDFEPVKTEAAQLDGGAAAGKNPFLVALGRRVAALRARRGLTRKAVALAADVSERHLANLEYGLGNASILVLLQVAGALQCSLAEIIGDRTTTSPEWLMIRELLEQRDDATLRRVRIVIGEMLGTGGGNVIRSPRIALIGLRGAGKSSLGQLLADDLGFPFVELSREIEKFAGCSVSEIQALYGMNAYRRYERRALEETIQIYPEAVIATPGGLVSDPATFNLLLSHCTTVWLQATPEDHMRRVMEQGDLRPMANSKEAMEDLKDILAGRAPFYSKAEFTVNTSAQPLLPTSAALRELVRNALDLPLDEKIRKHA

SEQ ID NO: 9643 - protein, 324 aa, Polaromonas naphthalenivorans CJ2
MSSNILHASGLVPDTSILPLQTAELPPAGLQEPQVEEKNLFLAALGDRVRALRARRGMTRKAVSIAADVSERHLANLEYGEGNASILVLLQVARALHCSLAELIGDVTTSTPEWLLIRELLETRDDASLRRVRIAIGELLGTGSGNTTLCSRVALIGLRGAGKSTLGALLAEDLGFPFVELSREIEKFAGCSVSEIQALYGMNAYRRYERRALEETIQIYPEAVIATPGGLVSDPATFNQLLSHCTTVWLQADPEDHMKRVLAQGDLRPMAASKQAMEDLKGILAGRAAFYSKAQYKVDTSTQSLELSFQALREMVRKALQLPV

SEQ ID NO: 9644 - protein, 315 aa, Verminephrobacter eiseniae EF01-2
MNERQEAGAGLSTSASPQAAAPTDEAKNPLLVALGERVRKLRAQRGLTRKAVALAAGISERHLANLEYGTGNASILVLQQVAGALHCSLAELQGDFTTRSPEWLLIRELLEHRSEPQLRRARLALHALLNGADDPARHSRIALVGLRGAGKSTLGPLLARALDMPFVELSHAIESLAGCSVREIHNLYGTMAYRRHERRALEETLQIHSEVVIATPGGIVSDPATFQQLLAHCTTVWLRAAPEEHMGRVVAQGDMRPMADSQEAMDDLRRILDGRAAFYSKADITIDTSGQTPDQSLQALVSGVRKAMGMGSSRD

SEQ ID NO: 9645 - protein, 342 aa, Bradyrhizobium BTAi1
MSRIRPLQRRSAPPQDQRQDSFPVAGEAVPDRFLSELGARVRTMRAVRGMSRKVLAQTSGVSERYIAQLESGQGNVSIMLLRRLAEVAGVQLEDLVADPAGRPKDWVLIRELLMQAPPVVIDDVKALLTGRPLDRPTQTANIQVDRVALIGLRGAGKSTLGRLLAEQLGWRFVELNREIERDAGFSVSEVFSLYGQDAYRRFEQAALARIVAEPGPMVLAVGGGIVSDPVTFERLLAEYFCIWIKASPTEHMERVRAQGDVRPMADDSSAMSELVTILKSREALYARARASLDTSGARVGDSVQALLRMVRNYCTAGCPYVARNRIAAAGANGPVCEAAAER

SEQ ID NO: 9646 - protein, 304 aa, Delftia acidovorans SPH-1
MDQFETAAQSAGAADSLSEAPRNQVLQALGERVRSLRSRRGMTRRALAAAADVSERHLANLEYGTGNVSVLVLHHIAQALQCSMAELLGDVTTTSAEWLLIRELLEGRNEEDLRRVRLAAGELLGTAPSDRQRHTRIALIGLRGAGKSTLGRMLAEQLGVPFLELNQEIERIAGCSVRAIHDLYGANAYRRYERRALEEAVQIYSDVVIATPGGIVSDPATFNELLSHCTTVWLKAQPEEHMARVVAQGDTRPMAANPEAMDDLRSILEGRAGFYAKADHVVDTSGQTLEQSFDQLKALFLPAR

SEQ ID NO: 9647 - protein, 317 aa, Burkholderia phymatum STM815
MNQTYSADASLAQRANEEAPKAEREERDPFLTAMGERVRLLRARRGMTRKTLASETGLSERHLANLESGVGNASVLVLRQIAATLNCPLAEVIGDETTSSAEWLLIRELLHGRDQAALQRARVALSEMFAQAPRDPHRKDRIALIGLRGAGKSTLGRMLAQERKVPFIEITKVIQQMAGCPPSEIHSLYGASAYRRYEQRALEAVIGEHERAVIASPGGLVSEPATFNALLAHCFTVWLQASPEEHMRRVVAQGDLRPMSGNKEAMEDLKRILAGRGELYNRADMIFDTSERTLADAYLQLRDRLAARLAAELGDET

SEQ ID NO: 9648 - protein, 374 aa, Burkholderia phytofirmans PsJN
MHASRRAISVTLPKVLNSVCYWINIWRKLTVHLVSVKHYSTCIEVNGQQNMNQNYSSVPLADSADEDASRAERVPERGAERDPFLTAMGERVRLLRARRGMTRKTLAAETGLSERHLANLESGVGNASVLVLRQIAGTLNCSLAEVIGDETTASAEWLLIRELLQGRDQAALQRARVALAEMFAQAPRDPHRKDRIALIGLRGAGKSTLGRMLAQERKVPFVELTRVIEQLAGCPPSEIHSLYGAAAYRRYEHRALEAVIQEHERAVIASPGGLVSESGTFNTLLSHCYTVWLQAAPEEHMRRVVAQGDLRPMSGNKEAMDDLKRILAGRSELYARADMTFDTSEKTLADAYLQLRDRLAARLAAESPDEARLG

SEQ ID NO: 9649 - protein, 316 aa, Variovorax paradoxus S110
MNEHVDAVLAPAPEEGQRAGNPAAPAGEAKNPLLAALGERVRNLRAQRGLTRKAVAIAADVSERHLANLEYGIGNASILVLQQVAGALHCSLAELVGDVTTSSPEWLLIRELLENRSEADLRRVRVAVGELLGTASVDPARHRRIALVGLRGAGKSTLGQMLADDLDVPFVELSRDIEKLAGCSVREIHDLYGTNAYRRYERRALEEAIQIYGEVVIATPGGIVSDPATFNELLAHCTTVWLQAAPEEHMGRVAAQGDTRPMAASKEAMEDLRRILNGRAAFYSKADLSVDTSGKTLAQSFQALRTVARQAIGTGA

SEQ ID NO: 9650 - protein, 151 aa, Jannaschia CCS1
MTSGRFIVFVILGVTAVFGATLWWANTRAYYAPLEVVEIAVQRPDGALVPLEIVDAEGIDATTSPLRFRACFTLSDDAPLADAAPYDDATPLIPPAWFDCFDATQIGEALEAGEAQAYLGQRNASRGVDRVVAIFPDGRGYAWTQLNGTLE

SEQ ID NO: 9651 - protein, 175 aa, Ruegeria sp. TM1040
MTGKILSIILIVSGLVAGIAMYYLQVYGFYDEVVAEPGRDVVLMPIGGEAPQAIAYSDFKAIDADSSPIRYRACFATPLKPAELAQLYELSEARDPRNAPEWFDCFDAAAIGAALKDGRARAFISEKNIEFGVDRIVAVTEDGRGYVWHELNNCGEKAYDGTIVGEECPKRPQSN

SEQ ID NO: 9652 - protein, 156 aa, Rhodobacter sphaeroides 2 4 1
MNGKLLVGGIVLSALAAGAVMWWAQLYAYYEEASFAPGEEIRLTPILGDAPEAIVANEVTGIDSGSSPLRFRACFTTPLSQAMLTETYRVYPDPTPLNAPPWFDCFDAERIDMALQKGEAIAFLSEHDIAPGVDRVVAVFPDGHAFAWHQLNAEEQ

SEQ ID NO: 9653 - protein, 160 aa, Paracoccus denitrificans PD1222
MSSGKIVASMLVLVAVMAGLAVWYLQVYGFYDQVDEISGAQDIVVTDAQGATHPVAVADFKAIDATSSPIRYRACFTLDPAELADAAPYAGATPLNGPGWFKCYSARALTADLESGAARAVLGQAEIRPDVDRVIVVYPDGRAFAWHQFNDKTPERGVMD

SEQ ID NO: 9654 - protein, 156 aa, Rhodobacter sphaeroides ATCC 17029; identical to SEQ ID NO: 9652

SEQ ID NO: 9655 - protein, 156 aa, Rhodobacter sphaeroides ATCC 17025
MNGKLLAGGIVLIALIAGAAVWWTQLHAYYEEVSFDRGNEIRLTPLLGEVPEVIVADGVKGIDADSSPLRFRACFTTPLSQAMLTETYRVYPTPTPLNAPPWFDCFDAPRIDAALRRGEAIAFLSEHDIAPGVDRVVAVFPDGHAYAWHQLNAEEQ

SEQ ID NO: 9656 - protein, 158 aa, Dinoroseobacter shibae DFL 12
MNRGKLVGGAIVGFALIFGIVVYYTQIYAYYEQVDAETVTIRLTPLGGQDAPEPMLATNLQAIDGSSSPLRFRACFDTSESLALLTESYVIHDAAVPLNAPGWFDCFDAARIGADLRDGTALAFLGEAEIADGVDRIVAVYRDGRAFAWHQLNEKFAD

SEQ ID NO: 9657 - protein, 301 aa, Polaromonas JS666
MGISQYIKVIGRGKQGARAITREQAADLFGQVLDRTVTDLEIGGFCLAMRIKGETPEEMAGFLDATYQRLNHLPATERPLVVLPSYNGARKLPVLTPLLALLLAREGLPVLVHGTATESSRIFASDVLAALDIHALTATRTIASGEVAFAATELLCPGLKQLLDVRRAVGLRNPAHSLVKIMNPCLGKSLVVSSYTHPEYAISMAQTFELIQANALLLRGTEGEVVADARRTPQMEAFIAGKRTLLQASQPGTLASVPDLPKEIDSASTAAYIRAVLSGTHAVPASIARQVEHILQLVSQL

SEQ ID NO: 9658 - protein, 308 aa, Acidovorax avenae citrulli AAC00-1
MGSISHYLKDLGRGARGARAIGREQAADLFGQVLDGQVTDYEVGAFCIAMRIKGETADEMCGFLDATHARLAPVPAGEVPTVVLPSYNGARRLPVLTPLLALLLAREGLPVLLHGMRTEARRVLASDVLQALGVAPMESPEAVAPGSVAHVRTGLLSPGLARLLAVREVVGLRNPGHSVVKLMNPVRGPSLLVTAYTHPEYLDMLHATFTARGMDVLLSRGLEGEVAADPRRTPRYDAFVRGAHHVWDEQQPGTASEVPGLPADIDVDTTARYTQQVLAGELPVPAPLSRQVEHILRLARQNSTETAP

SEQ ID NO: 9659 - protein, 309 aa, Acidovorax sp. JS42
MGISHYIKEIGRGARGAKALDRAQAADLFGQVLDGQVTDLEIGAFCVAMRIKGETAEEMCGLLDAVHARITAIPACADGQPLIVLPSYNGARKLPVLTPLLALLLAREGLPVLLHGMRTEARRILASDVLEALDIPALTAPQSIAPGSVAHIGTAVLLPGLARLLAVREVIGLRTPGHSVAKLMNPCAGPALVVSSFTHPEYFDILSGTFATLGAHALLSRGLEGEVAADPRRTPRYDAFIGGTHQLLQDQQPGTAAEVPGLPTEIDVATTAAYTRRVLAGDAPVPPALRQQVEHILHLSRQITAQASS

SEQ ID NO: 9660 - protein, 301 aa, Polaromonas naphthalenivorans CJ2
MSISHYIKEIGRGKDGARPLSRAQAADLLGQVLDGVVTDLEIGGFCLAMRIKGETPEEMAGFLDAVHQRLNLLPASDGPTVVLPSYNGARKLPVLTPLLALLLAREGLSVLVHGTPTESSRVFSSEVLSALGTQALTAIKPIAPGEVVFAPTELLSPALKRLLDVRRAVGLRNPAHSLVKLMNPVAGKALVVSSYTHPEYALSMAATFELVQADALLLRGTEGEGVADPRRSPQMQGFVKGQRVLAHEGVKGTLPSVPDLPKAIDASSTAAYIQSVLAGDSPLPPSIAQQVEHILQLVRQL

SEQ ID NO: 9661 - protein, 318 aa, Methylibium petroleiphilum PM1
MGIAHYLKEIGRGKEGARSLTEAQARDLMNQVLDRTVSEAERGAFAIAMRIKGESTEELAGFTACAAERSLVLEADAMPVLLPSYNGARKLPNLTPLLALLLAQEGVPVLVHGPLHDPARVTTYELFESLGLPIARDAAGVHDAWARHEPVFVPTAVLCPALVPLLELRWVLGLRNPAHTVAKLLTPRGRACLRVVNYTHPEYAAAHTRFLQHTGAHALLMRGTEGEPVADARRLPKLDIFIAGTPRPELGRSAVEGVLAELPLLPRSSDAATTAVYIQAVVSGEKPVPGPLVEQVEVLVRAHAAMRQHEERTHERSA

SEQ ID NO: 9662 - protein, 326 aa, Burkholderia mallei NCTC 10247
MTDSDAHATEPPDHFPCARLIKEIGRGPNGARALPYDDAFALYRAMLDGHVSDVELGAVLIAYRLKGETADELAAMLAAAHASFEPLHVQDAMFRTVSIPSYNGARRQPNLVPLLALLLAREGVPVLVHGVTEDPGRVTSAEIFAELTIAPGSTHDEIEDTLAERRAAFAPIEVLAPKLARLLALRRVLGVRNSTHTIVKLLQPFEPAGLRLVNYTHPPYRDSLVELFRGHPAAAAGGALLARGTEGEAVADTRRQVQVDWLHDGHCETIVEPARASSDAPPVELPASRDAATTAAWTDSVMRGEIPVPDAIAMQVDTIVRLARLA

SEQ ID NO: 9663 - protein, 326 aa, Burkholderia pseudomallei 668
MTDSDAHATEPPDHFPCARLIKEIGRGPNGARALPYDDAFALYRAMLDGHVSDVELGAVLIAYRLKGETADELAAMLAAAHASFEPLHVQDAMFRTVSIPSYNGARRQPNLVPLLALLLAREGVPVLVHGVTEDPGRVTSAEIFAELAIAPGSTHDEIEDTLAERRAAFAPIEVLAPKLARLLALRRVLGVRNSTHTIVKLLQPFEPAGLRLVNYTHPPYRDSLVELFRGHPAAAAGGALLARGTEGEAVADTRRQVQVDWLHDGHCETIVEPARASSDAPPVELPASRDAATTAAWTDSVMRGEIPVPDAIAMQVDTIVRLARLA

SEQ ID NO: 9664 - protein, 326 aa, Burkholderia pseudomallei 1106a; identical to SEQ ID NO: 9663

SEQ ID NO: 9665 - protein, 302 aa, Polynucleobacter necessarius asymbioticus QLW P1DMWA 1
MSITSFLKVIGRGSKGAGDLDRNQAKEVFTQILDGNVSDLELGAFCIAMRIKGESVSELMGFMDALQPHLNLLNLGTRPTIVLPSYNGARKQANLTPLLSGMLVSYGFTVLVQGVEKDQTRITSHEIFKSLGWPILKTKDEFGALLALNQPIFCSLNVISPALQKLLDIRERIGLRNTSHVLAKLINPTLQKPWQVSNYTHPEYPEKLREFFQLRSANAILIRGSEGEPTASLQRLPEMHFLHANANEITTPEERFEDLSPFLDIDAISTASVTEQILSGQVKCPSSILRQAIQISTMAGLH

SEQ ID NO: 9666 - protein, 323 aa, Dinoroseobacter shibae DFL 12
MSLASYIAIVARGPGRARPLTETEARAAMGHVLDGTGAAEAVGALLMTLRLRGETEDEITGFAGALRDHMQRWRALDVDLDWPSYSAGRTRGLPWYLLSARLVAQAGYRVMLHGRNGGDAALRSYLAAQGVAIAQTPAAATAALDASGLVYIPLEALSRRTTDLLALRAHLGLRSCVNTCLRVANPAGARVTVQGVFHPPYRALQETACKRLGDTAAMIIKGGGGEFERHPGKAVVCHGHGPTGAWTDAPALLRDPRRLTEVTDNPAHLTALWNGTWHHPFALATVLGTAALALWSLGANQTLADAEAHAARLWATRSSRRAA

SEQ ID NO: 9667 - protein, 316 aa, Delftia acidovorans SPH-1
MPPQDSTHDCNAMGISQYIKEIGRGARGAKALDRPQAADLFGQVLDGGVSDLEIGAFCIAMRIKGETVEEMSGFLDAVHARVARFPASADGRPVIVLPSYNGARRLPVLTPLLALLLAREGLPVLLHGMRTEARRILASDVLQALGIAPLPSPQALAGGQVAHIHTEHLHLALARLLSVREVIGLRNPGHSVVKLLAPCDGPCLLVTAYTHPEYLPMLHGTFGTLGMNVLLSRGLEGEVAADPRRLPRYDGFVAGAHQLLAEQQSGTASDVPGLPAEIDMDTTARYTEDVLAGRLPVPPALTRQVEHIVHLADQIR

SEQ ID NO: 9668 - protein, 309 aa, Diaphorobacter TPSY uid29975
MGISHYIKEIGRGARGAKALDRAQAADLFGQVLDGQVTDLEIGAFCVAMRIKGETAEEMCGLLDAVHARMAAIPACAGGQPLIVLPSYNGARKLPVLTPLLALLLAREGLPVLLHGMRTEARRVLASDVLEALDIPALTAPQSIAPGSVAHIGTAVLLPGLARLLAVREVIGLRTPGHSVAKLMNPCAGPALVVSSFTHPEYFDILSGTFATLGAHALLSRGLEGEVAADPRRTPRYDAFIGGTHQLLQDQQPGTAAEVPGLPAEIDVATTAAYTRRVLAGDAPVPPALRQQVEHILHLSRQITAQASS

SEQ ID NO: 9669 - protein, 301 aa, Variovorax paradoxus S110
MGISQYIKEIGRGARGAKPLTREQAADLFGQVLDGTVTDLEIGGFCLAMRIKGETPEEMAGFLDATHARLNRLPAADRPLIVLPSYNGARRLPVLTPLLALLLAREGLPVLVHGSATETSRVLASNVLEALDVPALPAIRKIPSGEVGFAPTELLNPALKRLLDVRRVVGLRNPGHSVVKLMQPTTGPCVIVASYTHPEYARTMGETFELMGMTALLSRGLEGEVVSDPRRTAQIDGFVRGVRSELQAQESGTASEVPGLPKEIDVATTAAYTRRVLDGELPVPEAIATQVRHITQLASHA

SEQ ID NO: 9670 - protein, 190 aa, Brucella suis 1330
MFQRRYPPTRWERLRLYLWPRRSFSRSFRYGGKRILRITASPHAVAAGLAVGVFSAFTPFFGFHLIIAIVLAYFLAGNVAAAALGTTLANPLTLPFIWGSTFELGRFIMSGSVDSVPPVHLGHALETMRFEEVWTPLLKPMLFGSTILGAAFAVLVYFVTRYAVSVFRRRRLERLAEKHRLHRQRELQKA

SEQ ID NO: 9671 - protein, 177 aa, Mesorhizobium BNC1
MVWPRRSYQRSATYLVKRALRLSATPHAIAAGVAAGVFASFTPFMGFHIIIAAAVAWVIRGNLVASALGTFVGNPLTFPFIWGATLETGKFILRGEHPAGIGPKDIGHMLWHLEFEKLWEPLLKPMAIGSLPLGLLAGLIFYFVTRGATNAFREERRKRLAERARRRAAGGADAVAS

SEQ ID NO: 9672 - protein, 200 aa, Bartonella bacilliformis KC583
MLFRHQKPINLRERIRLLVWPRRSFARSFHYICKRILRISATPHKVALGFAIGIFSACSPFFGLHIILAVFFSWILRGNFTAAIIGTIFSNPVTFFPIIVVDYKVGYLFLSFFEHVDKISLVQIRTMFDGLTFSQIWLVFWETWDLVMIPMILGGVFLGSILGGLFYIGVYSGTVRFQKKRYRKIMEKVNLHQENQKSVS

SEQ ID NO: 9673 - protein, 190 aa, Brucella ovis; identical to SEQ ID NO: 9670

SEQ ID NO: 9674 - protein, 210 aa, Sinorhizobium medicae WSM419
MFRPSRGGRVRLAPAGGFECDHDGIMLFRRRKPVTISERLGAFFWPRKGFTRAPRYIALRVLRLNSSPHAIAVGVAAGAASSLTPFFGLHIVLAVLLASAFSGNLVAAAITTVLANPVTIPVILTASYEVGTMLTQPQAAQAVGGQEIMRMLEHLDLASLWGPVFKPMLIGSLPLAAAGGLIFYPLAFQTARLFQERRRRARAHRLGHPT

SEQ ID NO: 9675 - protein, 191 aa, Ochrobactrum anthropi ATCC 49188
MLFQRRNPPTRKERLRLLVWPRRSFSRSFRYGGKRILRITASPHAVAAGLAVGVFSAFTPFFGFHLIIAIVLAYFLAGNIAAAALGTTLANPLTLPFIWGSTFELGRFIMNGSIDDAPPVHLGRALETMHLDEIWTPLLKPMLFGSTILGAAFAVVVYFVTRFAVSAFRRRRIERLAEKHRLHREQELQKV

SEQ ID NO: 9676 - protein, 196 aa, Rhizobium leguminosarum bv  trifolii WSM2304
MLFRRRKPAGFKEKMRELLWPRKGFLRPLRYLTMRILRLSASPHAVAAGVAAGVFVSWTPFIGVHFVMAFVITYFLSGSMVAAALGCAAFGNPLTYPFIWGITWEIGHLLLSREDHLAGQAVDLAALFHRLNFTELWRPVLEPMLVGAIPPGIVTSVALYALTFYTVKGFQTRRHTRLLERARLRLASPAGDLPSV

SEQ ID NO: 9677 - protein, 196 aa, Rhizobium leguminosarum bv  trifolii WSM1325
MLFRRRKPAGFKEKMRELLWPRKGFLRPIRYLTMRVLRLSASPHAVAAGVAAGVFVSWTPFIGVHFVMAFVITYFLSGSMVAAALGCAAFGNPLTYPFIWGITWEIGHLLLSRKDQLAGQTVDLAALFHKLNFTELWRPVLEPMLVGAIPPAIVTSVALYALTFYTARGFQTRRHIRLMERARLRLAVPAGNMPSV

SEQ ID NO: 9678 - protein, 150 aa, Ralstonia eutropha JMP134
MNMPIEKINEDIRYVDDDDDVAACFGLMRQLRPHLADVNELIARWRRQQSAGYRLMAVWDEGRPVALAGFRLQDNLVHGVHFYVDDLVTDESARSGGYGARLMDRLKNEARALGCTKLVLDTPLTNVLGHRFYYRNGLLASALRFNIVLD

SEQ ID NO: 9679 - protein, 149 aa, Burkholderia 383
MPEIHLKRAVTDEDYRSAFDVMRELRPHLTDVDAFVRQMRRQAEQGYVLLTARHGSPDGAVVALAGYRHLENTVYGRFVYVDDLVATEHARGQRLGERLLDAVRNDARQLGCAQLVLDTGLSNALAQRFYFRQGLLSRGMHFTQPLQAR

SEQ ID NO: 9680 - protein, 149 aa, Cupriavidus metallidurans CH34 uid250
MNGVTAEQIEIRGIDTPGDVAAAFPLMHQLRPHLQDADELVTRWQRQTGDGYRLVGLWNDGPLVALAGYRYAENLVYGPYCYVDDLVTDAAARSGGYGQMLMDWLKTKAHAQGCARLVLDTPLDNVLGHRFYYRNGLLARALRFNYVFD

SEQ ID NO: 9681 - protein, 160 aa, Pseudomonas putida W619
MKFPLHNFIPSVLDLADTALRPLDSTHDLCSAFPVMQQLRPHLTSEADFVRRIERMRLEGYRLIGAYDAGVLVALAGYRLQENLVYGAFLYVDDLVTAEAQRGGQWGSRLLQALERLARASGCARLVLDTGLANARAQRFYFREGLLTGALRFQKQFDTP

SEQ ID NO: 9682 - protein, 149 aa, Ralstonia pickettii 12J
MTMDAVRPIEDEAALRACFPVMHQLRPHLADADELVARWRRQVQDGYRLIAVWRDGVPVALAGYRQQENLVYGPFLYVDDLVTDANLRSSGLGNVLMSHLKAEAERLGCARLVLDTPLSNVLGHRFYYRNGLLAGALRFGMNTKTGAAR

SEQ ID NO: 9683 - protein, 155 aa, Burkholderia phytofirmans PsJN
MPASLRFVHLDTPELLLPAFDVMRQLRPHLTDAHSFAAQVARQHADGYRLLAASDASGIVGLAGYRILTNLLYGRFVYVDDLVVDGKLQRDGIGAQLLDAVRQIAREAGCVQFVLDTGLHMPLAQRFYFRNGLLARGMHFVEPLAPLSPASALTP

SEQ ID NO: 9684 - protein, 149 aa, Ralstonia pickettii 12D; identical to SEQ ID NO: 9682

SEQ ID NO: 9685 - protein, 99 aa, Enterobacter sp. 638
MESVRRRLKPLFKEWNMQQNSQPIDRETLLIEANKLIRDHEDTLAGIEATGVEQRNGVLVFSGEYFLDEQGLPTPKSTAVFNMFKYLAHALSEKYHLID

SEQ ID NO: 9686 - protein, 82 aa, Vibrio cholerae O395
MNHKKPITEFELLLIANQLIQDHECYIEGMRATQVEEKEGVLVFKGEYFLTEQGLPTEKTTAVFNMFKYLAHHLSPEFTLQK

SEQ ID NO: 9687 - protein, 82 aa, Vibrio harveyi ATCC BAA-1116
MSDRKYIEEFDLLLIANQIIQEHDDYIDGMRATSVEEKDDVLVFKGEYFLDEKGLPTTNTTAVFNMFKYLAHHLSKEFTLNK

SEQ ID NO: 9688 - protein, 83 aa, Serratia proteamaculans 568
MRAETSPIAREALLEEANNLIRQHDDYLQGMVATDVEQKGSVLVFRGEFFLDPDGLPTIKTTAVFNMFKHLAHVFSDKYHLVD

SEQ ID NO: 9689 - protein, 83 aa, Yersinia pestis Angola
MHVNTTPIERSKLLAEANEIIRQHEDYLHGMHATDVEQKGPVLVFRGEYFLDAEGLPTAKTTAVFNMFKHLAHVLSAKYHLID

SEQ ID NO: 9690 - protein, 83 aa, Salmonella enterica serovar Newport SL254
MHKETQPIDRETLLLEANKIIREHEDTMAGIVATGVTQRNGVLVFSGDYFLDEQGLPTPKSTAVFNMFKHLAHVLSEKYHLVD

SEQ ID NO: 9691 - protein, 83 aa, Salmonella enterica serovar Heidelberg SL476; identical to SEQ ID NO: 9690

SEQ ID NO: 9692 - protein, 83 aa, Salmonella enterica serovar Schwarzengrund CVM19633; identical to SEQ ID NO: 9690

SEQ ID NO: 9693 - protein, 83 aa, Salmonella enterica serovar Agona SL483; identical to SEQ ID NO: 9690

SEQ ID NO: 9694 - protein, 83 aa, Salmonella enterica serovar Dublin CT 02021853; identical to SEQ ID NO: 9690

SEQ ID NO: 9695 - protein, 88 aa, Dickeya dadantii Ech703
MSDFNSIDKKMPIARDALLAEANTLIKDHEDYLNGMFANDVEQKNGVLIFRGEYFLDIDGLPTTKTTAVFNMFKHLAHVLSEKYYLTD

SEQ ID NO: 9696 - protein, 89 aa, Dickeya zeae Ech1591
MSVFTHINEEKTPISREALLQEANTLIQNHDDYLHGMVADAVEQKNGVLVFRGEYFLDNEGLPTQKTTAVFNMFKHLALVLSEKYQLVD

SEQ ID NO: 9697 - protein, 89 aa, Pectobacterium carotovorum PC1
MSPEHQVNEEKRPIDRQSLLIEANDIIKHHDDYLHGMVADSVEQKNGVLVFRGEFFLDDNGMPTLKSTAVFNMFKHLAHVLSEKYYLID

SEQ ID NO: 9698 - protein, 390 aa, Escherichia coli BL21 (DE3)
MKFVDEASILVVAGDGGNGCVSFRREKYIPKGGPDGGDGGDGGDVWMEADENLNTLIDYRFEKSFRAERGQNGASRDCTGKRGKDVTIKVPVGTRVIDQGTGETMGDMTKHGQRLLVAKGGWHGLGNTRFKSSVNRTPRQKTNGTPGDKRELLLELMLLADVGMLGMPNAGKSTFIRAVSAAKPKVADYPFTTLVPSLGVVRMDNEKSFVVADIPGLIEGAAEGAGLGIRFLKHLERCRVLLHLIDIDPIDGTDPVENARIIISELEKYSQDLAAKPRWLVFNKIDLLDKAEAEEKAKAIAEALGWEDKYYLISAASGLGVKDLCWDVMTFIIENPVVQAEEAKQPEKVEFMWDDYHRQQLEEIAEEDDEDWDDDWDEDDEEGVEFIYKR

SEQ ID NO: 9699 - protein, 392 aa, Haemophilus somnus 129PT
MKFIDEALIRIEAGDGGNGCVSFRREKFIPKGGPDGGDGGDGGDVYLIADENLNTLIDYRFEKRFAAERGENGRSSDCTGRRGKDITLRVPVGTRAIDNDTKEVLGDLTKHGTKMLVAKGGYHGLGNARFKSSVNRAPRQKTNGTPGEKRDLQLELMLLADVGMLGLPNAGKSTFIRAVSAAKPKVADYPFTTLVPSLGVTRVDTSRSFVIADIPGLIEGASEGAGLGVRFLKHLERCHVLIHLVDIAPIDESDPADNIAIIEGELFQYSEKLANKPRWLVFNKIDTLSDEEATARAKNIMQRLGGEDDYYLISAATGKNVDVLCRDIMDFIEENPRQEQEKIDAQEVKFKWDDYHQEQLSEQVFTEDDQEGDDWDDWSEDDEEGVEIIYKP

SEQ ID NO: 9700 - protein, 392 aa, Enterobacter sp. 638
MKFVDEATILVVAGDGGNGCVSFRREKYIPRGGPDGGDGGDGGDVWLEADENLNTLIDYRFEKSFRAERGQNGQSRDCTGKRGKDVTVKVPVGTRVIDQGTGETLGDMTKHGQRLMVGKGGWHGLGNSRFKSSVNRSPRQKTMGTPGDKRDLQLELMLLADVGMLGMPNAGKSTFIRSVSAAKPKVADYPFTTLVPSLGVVRMDNEKSFVVADIPGLIEGAAEGAGLGIRFLKHLERCRVLLHLIDIDPIDGSDPVENARIIVGELEKYSDKLAAKPRWLVFNKIDLMDKAEAEAKAKAIAEAMGWEDKYYLISAASQMGVKDLCWDVMAFIIENPITQAEEAKQPEKVEFMWDDYHRQQLEEQEVEVEDDEEWDEDWDEDDEEGVEFIYKR

SEQ ID NO: 9701 - protein, 390 aa, Yersinia pseudotuberculosis IP 31758
MKFVDEAAILVVAGDGGNGCVSFRREKYIPNGGPDGGDGGDGGDIYLLADENLNTLIDYRFVKSFRAERGQNGQSRDCTGKRGKDITIKVPVGTRVLDQGTGEIVGDMVRHGQRLMVAKGGFHGLGNSRFKSSVNRAPRQKTMGTEGETRELMLELLLLADVGMLGLPNAGKSTFIRAVSAAKPKVADYPFTTLIPSLGVVRMDYEQSFVIADIPGLIEGASDGAGLGIRFLKHLERCRVLLHLVDLAPIDESDPAENAKVIVNELQQYSENLAEKPRWLVFNKIDLIDPEEAEKRAKAIVETLGWEGKYYMISAANRDNVNALCWDVMSFLNSQPKAMAIAESVPEKVEFMWDDYHREQLAEVEAEAEDDWDDDWDEEDDDGVEIIYER

SEQ ID NO: 9702 - protein, 390 aa, Escherichia coli HS; identical to SEQ ID NO: 9698

SEQ ID NO: 9703 - protein, 390 aa, Escherichia coli E24377A; identical to SEQ ID NO: 9698

SEQ ID NO: 9704 - protein, 390 aa, Serratia proteamaculans 568
MKFVDEAAILVVAGDGGNGCVSFRREKYIPNGGPDGGDGGDGGDVYLLADENLNTLIDYRFEKSFRAERGQNGQSRDCTGKRGKDITIKVPVGTRVQDQGTGEILGDMTRHEQRLMVAKGGWHGLGNTRFKSSVNRAPRQKTLGTAGEARDILLELLLLADVGMLGLPNAGKSTFIRAVSAAKPKVADYPFTTLVPSLGVVRMDHEQSFVVADIPGLIEGASDGAGLGIRFLKHLERCRVLLHLVDIAPIDESDPVENAKVIINELNQYSENLSQKPRWLVFNKIDVIGEEEAAERAKAIAEGMGWEGKYYMISAVNREGVNALCWDVMKFINTQPKAMAIEESAPEKVEFMWDDYHREQIAEVEAEADDDWDDDWDEEDDEGVEIIYQK

SEQ ID NO: 9705 - protein, 390 aa, Escherichia coli C ATCC 8739; identical to SEQ ID NO: 9698

SEQ ID NO: 9706 - protein, 390 aa, Escherichia coli SMS 3 5; identical to SEQ ID NO: 9698

SEQ ID NO: 9707 - protein, 390 aa, Shigella boydii CDC 3083 94; identical to SEQ ID NO: 9698

SEQ ID NO: 9708 - protein, 390 aa, Salmonella enterica serovar Newport SL254
MKFVDEASILVVAGDGGNGCVSFRREKYIPKGGPDGGDGGDGGDVWMEADENLNTLIDYRFEKSFRAERGQNGASRDCTGKRGKDVTIKVPVGTRVIDQGTGETMGDMTKHGQRLLVAKGGWHGLGNTRFKSSVNRTPRQKTNGTPGDKRDLLLELMLLADVGMLGMPNAGKSTFIRAVSAAKPKVADYPFTTLVPSLGVVRMDSEKSFVVADIPGLIEGAAEGAGLGIRFLKHLERCRVLLHLIDIDPIDGSDPVENARIIIGELEKYSQDLAAKPRWLVFNKIDLMDKTEAEEKAKAIAEALGWEGKYYLISAASQLGVKDLCWDVMTFIIENPIAQAEEAKQPEKVEFMWDDYHRQQLAEVEEDADDDWDDDWDEDDEEGVEFIYKR

SEQ ID NO: 9709 - protein, 390 aa, Salmonella enterica serovar Heidelberg SL476; identical to SEQ ID NO: 9708

SEQ ID NO: 9710 - protein, 390 aa, Salmonella enterica serovar Schwarzengrund CVM19633; identical to SEQ ID NO: 9708

SEQ ID NO: 9711 - protein, 390 aa, Salmonella enterica serovar Agona SL483; identical to SEQ ID NO: 9708

SEQ ID NO: 9712 - protein, 390 aa, Escherichia coli O157 H7 EC4115
MKFVDEASILVVAGDGGNGCVSFRREKYIPKGGPDGGDGGDGGDVWMEADENLNTLIDYRFEKSFRAERGQNGASRDCTGKRGKDVTIKVPVGTRVIDQGTGETMGDMTKHGQRLLVAKGGWHGLGNTRFKSSVNRTPRQKTNGTPGDKRELLLELMLLADVGMLGMPNAGKSTFIRAVSAAKPKVADYPFTTLVPSLGVVRMDNEKSFVVADIPGLIEGAAEGAGLGIRFLKHLERCRVLLHLIDIDPIDGTDPVENARIIISELEKYSQDLAAKPRWLVFNKIDLLDKVEAEEKAKAIAEALGWEDKYYLISAASGLGVKDLCWDVMTFIIENPVVQAEEAKQPEKVEFMWDDYHRQQLEEIAEEDDEDWDDDWDEDDEEGVEFIYKR

SEQ ID NO: 9713 - protein, 392 aa, Dickeya dadantii Ech703
MKFVDEATILVVAGDGGNGCVSFRREKYIPNGGPDGGDGGDGGDVYLLADENLNTLIDYRFEKSFRAERGQNGQSRDCTGKRGKDIVIKVPVGTRIRDKGTDEILGDMTRHQQRLLVAKGGWHGLGNTRFKSSVNRAPRQKTSGTPGEERELLLELLLLADVGMLGLPNAGKSTFIRAVSAAKPKVADYPFTTLVPSLGVVRMDSEQSFVIADIPGLIEGASEGAGLGIRFLRHLERCRVLLHLIDLAPMDESDPIQNAKVIVNELHSYSATLAEKPRWLVFNKVDLLDHAEGEKRAKEIANALGWEGKYYLVSAANRAGVNALCWDVMSFLNANPKIMETEEGAAASQKVEFMWDDYHREQLESADEDMEEDLDDDWDEDDDEGVEIIYQR

SEQ ID NO: 9714 - protein, 391 aa, Dickeya zeae Ech1591
MKFVDEATILVVAGDGGNGCVSFRREKYIPNGGPDGGDGGDGGDVYLLADENLNTLIDYRFEKSFRAERGQNGQSRDCTGKRGKDITIKVPVGTRILDKSTGEVLGDMTRNQQKLMVAKGGWHGLGNTRFKSSVNRAPRQKTNGTPGEERELLLELLLLADVGMLGLPNAGKSTFIRAVSAAKPKVADYPFTTLVPSLGVVRMDSEKSFVVADIPGLIEGASEGAGLGIRFLKHLERCRVLLHLIDLAPIDESDPIENAKVIVNELQQYSASLAEKPRWLVFNKVDMLEKGEAEKRAKAIAAALGWEGKYYLISAANREGVNALCWDVMNFLNTQPKALAEVENKAPEKVDFMWDDYHREQLEAVQAEAEEEWDDDWDEDDDEGVEIVYQR

SEQ ID NO: 9715 - protein, 390 aa, Pectobacterium carotovorum PC1
MKFVDEATILVVAGDGGNGCVSFRREKYIPNGGPDGGDGGDGGDVYLLADENLNTLIDYRFEKSFRAERGQNGQSRDCTGKRGKDITIKVPVGTRVLDQGTGEVLGDMTRHQQSLMVAKGGWHGLGNTRFKSSVNRAPRQKTSGTKGEERELTLELLLLADVGMLGLPNAGKSTFIRAVSAAKPKVADYPFTTLVPSLGVVRMDSEQSFVVADIPGLIEGASEGAGLGIRFLKHLERCRVLLHLVDLAPIDESDPVENAKIIINELEQYGAGLAEKPRWLVFNKVDLIDKAEAEKRAKEIATALGWEGKYYLISAANREGVTPLCWDVMSFLKANPKVTAIAESAPEKVEFMWDDYHRQQLAEIEKEAEEEWDDDWDDEDDEGVEIIYQK

SEQ ID NO: 9716 - protein, 132 aa, Escherichia coli BL21 (DE3)
MTWEYALIGLVVGIIIGAVAMRFGNRKLRQQQALQYELEKNKAELDEYREELVSHFARSAELLDTMAHDYRQLYQHMAKSSSSLLPELSAEANPFRNRLAESEASNDQAPVQMPRDYSEGASGLLRTGAKRD

SEQ ID NO: 9717 - protein, 151 aa, Colwellia psychrerythraea 34H
MNVVIALVIFIIGGIGGFFANRLLSSTSQEQRKLADQVNKSEAALDQYKLDVAEHLDSSAKLLDQMNNTCQTAMKQMKESTQLLQKATTVEAEGMPFFSAETQQQLAQTATLRHQKRASEAVEAMTEAPLDYSGNPSGLFADQKQKVTTTV

SEQ ID NO: 9718 - protein, 152 aa, Saccharophagus degradans 2-40
MVGAIVLCIGGLIGAVISRKFIPPEHQKELETNLQAAREDLKQYQQDVAQHFEETSRLVHNLTQSYKEVHEHLAKGAIHLTNSDISRQMLEAGDGNIGVEAGALLAETTVLPPRDWAPKTPGQKGTLSEEFGLLDEAEAENAEKPKEEKEIN

SEQ ID NO: 9719 - protein, 173 aa, Chromohalobacter salexigens DSM 3043
MAPGSVCPRTAHRMPVTFKESIVNESNIDWILAIACFLAGIGVGALGYHLLNANVARNQKVRQRLAEAELELSQVKDALNDHFTKAADLVTSIQRQSHELEQQLAQGADRLVDDLQLKRRLHQGQDDAVTDDDTDSPQVPRDYAEGAQGTLAENYGLESHKRRETEEPAPPRY

SEQ ID NO: 9720 - protein, 145 aa, Marinobacter aquaeolei VT8
MTNLILAAVAALVVGIVIGILVGRSGQGATLRQRRAEQQIEELRSEFTRYQAQVNEHFMESAHLLRRFNDAYRDVNQHMARGANRLCNDEDWMEELDQKSKGRLEHGSDGEPSEPPRDYAPKADPEAKGTLAEDYGLDKGEKRPA

SEQ ID NO: 9721 - protein, 132 aa, Enterobacter sp. 638
MTWEYALIGLVVGIAIGAVAMRFGNRKLRQQQSLQYELEKNKAELEEYREELVSHFARSAELLDNMATDYRQLYQHMAKSSSNLLPEMSAESNPFRNRLAESEASNDQVPVQMPRDYSDGASGLLRGGVKRD

SEQ ID NO: 9722 - protein, 145 aa, Vibrio cholerae O395
MPWIYAIAGLLVGIAVGMLIARLTTPQYKTQKNLQKELESAKFTLEQQRQELSDHFAQTAEMLDTLGKDYTKLYQHMAKTATDLIPNLPEQDNPFSKLAQQKEESKQPEELEQPPKDYALGATGLLRGEEKAIIRSADLLNAKAS

SEQ ID NO: 9723 - protein, 151 aa, Marinomonas MWYL1
MNLEEFNIIIFITGIIIGCVATLALKSYSAKNNSKKADSSSNIITMKSLQQELDSKQVIIDNFFTDSNEHLMSAEKRLADLRNTLADNATQLSNIKIERSTATSNNTDTIEPASFEPPRDYALKNDKEPGTLSESFGLDDRNIDLEPKRTI

SEQ ID NO: 9724 - protein, 134 aa, Yersinia pseudotuberculosis IP 31758
MTWEYALIGLVVGVVIGAVAMRFGNRKLRQQQVLQNELEKSKTDLEEYRQELVGHFARSAELLDNMARDYRQLYQHMAKSSNNLLPDLPLQDNPFRYRLTESEADNDQAPVKLPPRDYSEGASGLLRPEHQNRD

SEQ ID NO: 9725 - protein, 147 aa, Vibrio harveyi ATCC BAA-1116
MPWIYAIVGLLVGTIVGVVISRLTTPEYKKQKSVQKELEAAKFELEQQRQELVDHFAQTAEMLDTLGKDYTKLYQHMAKTSSELLPNLPEQDNPFDKKTAMSTESIEEDQSDVSEQPKDYANGATGLLKDQAKEIIDAPEAVTAKAS

SEQ ID NO: 9726 - protein, 132 aa, Escherichia coli HS; identical to SEQ ID NO: 9716

SEQ ID NO: 9727 - protein, 132 aa, Escherichia coli E24377A
MTWEYALIGLVVGIIIGAVTMRFGNRKLRQQQALQYELEKNKAELDEYREELVSHFARSAELLDTMAHDYRQLYQHMAKSSSSLLPELSAEANPFRNRLAESEASNDQAPVQMPRDYSEGASGLLRTGAKRD

SEQ ID NO: 9728 - protein, 133 aa, Serratia proteamaculans 568
MTWEYALIGLVVGIVIGAVAMRFGNRKLRQQQVLQNELDKSKTDLEEYRQELVGHFARSAELLDNMARDYRQLYQHMAKSSNNLLPDLPMQENPFRYRLTEAEADNDQTPVEMPRDYSEGASGLLRGERPRRD

SEQ ID NO: 9729 - protein, 134 aa, Yersinia pestis Angola; identical to SEQ ID NO: 9724

SEQ ID NO: 9730 - protein, 132 aa, Escherichia coli C ATCC 8739; identical to SEQ ID NO: 9716

SEQ ID NO: 9731 - protein, 132 aa, Escherichia coli SMS 3 5; identical to SEQ ID NO: 9716

SEQ ID NO: 9732 - protein, 132 aa, Shigella boydii CDC 3083 94; identical to SEQ ID NO: 9716

SEQ ID NO: 9733 - protein, 132 aa, Salmonella enterica serovar Newport SL254
MTWEYALIGLVVGIIIGAVAMRFGNRKLRQQQALQYELEKNKAELEEYREELVSHFARSAELLDTMAHDYRQLYQHMAKSSSSLLPEMSAESNPFRNRLAESEASNDQAPVQMPRDYSEGASGLLRSGAKRD

SEQ ID NO: 9734 - protein, 132 aa, Salmonella enterica serovar Heidelberg SL476; identical to SEQ ID NO: 9733

SEQ ID NO: 9735 - protein, 132 aa, Salmonella enterica serovar Schwarzengrund CVM19633; identical to SEQ ID NO: 9733

SEQ ID NO: 9736 - protein, 132 aa, Salmonella enterica serovar Agona SL483; identical to SEQ ID NO: 9733

SEQ ID NO: 9737 - protein, 132 aa, Salmonella enterica serovar Dublin CT 02021853; identical to SEQ ID NO: 9733

SEQ ID NO: 9738 - protein, 151 aa, Aliivibrio salmonicida LFI1238
MAWTYALIGLAIGISIGFIISRFTIPGIKQQKSLKQDLEKSKYELEQYRQELVDHFATSATMLEALAKDFNKMYDHMASTSKELMPNLPEQDNPFTARLDEMTLSPELNKKVAHIKEEVSKQPKDYANGATGLLKDEPLMDISAKKEDKIA

SEQ ID NO: 9739 - protein, 132 aa, Escherichia coli O157 H7 EC4115; identical to SEQ ID NO: 9716

SEQ ID NO: 9740 - protein, 134 aa, Dickeya dadantii Ech703
MAWEYALIGLVIGVIIGAVAMRFGNRKLRQQQVLQSELEKNKTELEQYRQELVTHFAHSAELLDNMARDYRQLYQHMAKSSNNLLPDTPVHENPFRYRLTEAESDNDQAPVNMPPRDYSDGASGLLQGSRPASK

SEQ ID NO: 9741 - protein, 134 aa, Dickeya zeae Ech1591
MTWESALIGFVIGVIIGAVAMRFGNRKLRQQQVLQNELEKNKTELEEYRQELVSHFAHSAELLDNMARDYRQLYQHMAKSSNNLLPDVPMQDNPFRYRLTEAESDNDQAPVDMPPRDYSGSASGLLRGARPTGK

SEQ ID NO: 9742 - protein, 134 aa, Pectobacterium carotovorum PC1
MTWEYALIGLVVGIIIGAVAMRFGNRKLRQQQVLQNELEKSKTELEDYRQELVGHFARSAELLDNMADDYRQLYQHMAKSSNNLLPNVPGQDNPFKYRLTESEADNDQAPVNMPPRDYSDGASGLLRGERPIRK

SEQ ID NO: 9743 - protein, 200 aa, Yersinia pseudotuberculosis IP 31758
MELSLFLSMVGFLWVAAITPGPNNMLLTSAGANFGFMRSIWLMLGIMLGMQSMLLLVAFGVGSLILIYPSLHLALKILGSLYLLWLAWKIATSAYEKLDTNVAPAKPLRLYQGWLLQFLNPKAWLMGLGSVASFSMAGAAYNHSILMISLGMFMVNLVAGIIWLGFGTLIGRLLGSRRAWFTFNISMGLLTAACVLLIWH

SEQ ID NO: 9744 - protein, 200 aa, Serratia proteamaculans 568
MDASLFLSMLGFLWVAAITPGPNNMLLTTSGANFGFMRSLLLMIGIMLGMQSILLLVAFGVGSLILVYPALHLVLKILGSLYLLWLAWKVATAAYEKLETDVAPPKPIRLYQGWLLQFLNPKAWLMALGAVASFSLAGAQYNASILAISLGIFVVNIIAGVIWLGFGTVIGRLLRSKKAWIIFNVSMGLLTAACVLLIWH

SEQ ID NO: 9745 - protein, 200 aa, Yersinia pestis Angola
MELSLFLSMVGFLWVAAITPGPNNMLLTSTGANFGFMRSIWLMLGIMLGMQSMLLLVAFGVGSLILIYPSLHLALKILGSLYLLWLAWKIATSAYEKLDTNVAPAKPLRLYQGWLLQFLNPKAWLMGLGSVASFSMAGAAYNHSILMISLGMFMVNLVAGIIWLGFGTLIGRLLGSRRAWFTFNISMGLLTAACVLLIWH

SEQ ID NO: 9746 - protein, 200 aa, Yersinia pseudotuberculosis YPIII; identical to SEQ ID NO: 9743

SEQ ID NO: 9747 - protein, 201 aa, Dickeya dadantii Ech703
MDHVSLFLSMLGFLWVAAITPGPNNMLLTASAANFGFLRSLPLMLGIMIGMQSILLLVSLGLGSLILLYPPLHLALKVLGSAYLLWLSWKIASAAYERLDLDTAPSAPMPLYQGGLLQFLNPKAWLMSLGAVAGFSLAGDGYTGSVLSISVAMALVNAVAGAVWLAFGAAIGRLLRSPVAWKRFNISMGILTAACVLMIWH

SEQ ID NO: 9748 - protein, 201 aa, Dickeya zeae Ech1591
MEHVSLFLSMLGFLWVTAITPGPNNMLLTASAANFGVLRSMSLMLGIMIGMQIMLLLVALGLGSLILLYPSLHLALKVLGSVYLLWLSWKIATAAYEKLDTDTAPPKPIPLYQGGLLQFLNPKAWLMSLGAVAGFSLAGDGYVGSVVAISVAMVCVNFVAGIIWLGFGAMIGRLLQSPRAWKIFNLVMGLLTATCVLMIWH

SEQ ID NO: 9749 - protein, 200 aa, Pectobacterium carotovorum PC1
MELSLFLSMLGFLWVAAITPGPNNMLLTTSGANFGFMRSLWLMIGIMLGMQSILLLVAFGVGGLILIYPSLHFILKVLGSAYLLWLAWKIATAAYERLETSVAPPKPIRLYQGWLLQFLNPKAWLMALGAVASFSLAGEEYNHSVIAISIGIVLVNLVSGVIWLGFGTIIGRLLRSKKAWIIFNVSMGLLTAACVLLIWH

SEQ ID NO: 9750 - protein, 118 aa, Bacillus anthracis Ames 0581
MIQTKDKIKVMRAEDLPIQIGKEVQMKGMSIALFRLSNGDIRAVENRCPHKNGPLAEGIVSGEFVFCPLHDWKISLLTGEVQKPDDGCIQTYEVEVINGDIYIYICNLQKEASPLASF

SEQ ID NO: 9751 - protein, 118 aa, Bacillus anthracis str Sterne; identical to SEQ ID NO: 9750

SEQ ID NO: 9752 - protein, 105 aa, Bacillus thuringiensis konkukian
MIQTKDKIKVMRAEDLPIQIGKEVQMKGMSIALFRLSNGDIRAVENRCPHKNGPLAEGIVSGEFVFCPLHDWKISLLTGEVQKPDDGCIQTYEVEVIDGDIYIYM

SEQ ID NO: 9753 - protein, 105 aa, Bacillus cereus ZK; identical to SEQ ID NO: 9752

SEQ ID NO: 9754 - protein, 103 aa, Dechloromonas aromatica RCB
MSNWKLICLLEDIPQLGSRIIKPATGGDIAIFRTSDDQVFAMHDKCPHKGGPLSQGIVHGKRVTCPLHGWNIGLEDGKAVAPDVGGCTKFEVKVEGGQVYLSV

SEQ ID NO: 9755 - protein, 129 aa, Acidovorax sp. JS42
MTTWTPICSLDDIPVLGARRVARPHGMDVAVFRNDAGGVFALLDRCPHKGGPLSQGIVFGNSVACPLHNWTIGLCDGQAAAPDEGCTPRFQVKVEAGSVYLDAQELAHHALDLQRPVAGPALRCKANPP

SEQ ID NO: 9756 - protein, 140 aa, Verminephrobacter eiseniae EF01-2
MTEHIPDWQAICRIDDIPVLGARRVARPRGLEVALFRNADGGIFALLDRCPHRGGPLSQGIVFGTRVACPLHNWTIDLCDGQAHAPDQGCTPRFAVKVDNGTVYLDRHELATLATDQTRPGAGPARPAQSAQSAQRASAA

SEQ ID NO: 9757 - protein, 166 aa, Geobacter sulfurreducens
MHIVMTIHGFALDSIAQMPVVLLKDERGEVTLPIWINGTDTLYIVAELIRRDASSSGERKDLLTALLGHLGAEVLDISIDGGKDGKFICSVRLMVGEEELRLPVRISEAIVLALKNALPVMVPRHLVEEATAPAGTMGDHFTEADERRFVDFLEGLDPADLGKYPM

SEQ ID NO: 9758 - protein, 166 aa, Geobacter metallireducens GS-15
MYLKMNIHGFALDSIAQRPVVLLKDADEANTIPIWINSSDTLYIVAELVRHDAAAKSDRKDLLSALLGHLDAEVAEIVIEDMKDGLFDASVGVLLDGETVLLPVRIPEALVLALKHSLPVMVADHLLNKIAKSNGDTDERFTDADARRFVDFLENLDPADLGKYPM

SEQ ID NO: 9759 - protein, 183 aa, Desulfovibrio desulfuricans G20
MLIEMKVLGLSLDETSKAPILILQQKDGKDVLPIWVGAMEAMAISIALNEVETPRPLTHDLMLSTLSSLGARLVSVNVTGLREGTYYAELEITCGSTLSRVDSRPSDAVALALRAGAPIRVSDEVLRLAEESRLKPSQGDPALLRRPADAAASFLRPEEAEKQSDEELEELLRKLDPVTRYKM

SEQ ID NO: 9760 - protein, 161 aa, Candidatus Koribacter versatilis Ellin345
MEVEMKIRGLMMDPVTNMPIVILKDVGSDTVLPIWVGVYEANAIALEIEKVTTPRPMTHDLLKNVLLGMEAQVEKVVVTELREDTFYAVIWVTRNGSPVSIDSRPSDALALALRVDCPIYVEDEVLKTSKQAAQISDRVTADDLRKWLEGLGDDDLGRYKM

SEQ ID NO: 9761 - protein, 160 aa, Moorella thermoacetica ATCC 39073
MLIPVKVKQIVLDQTLNPVVLLGEPEGNQVLPIWVGPFEAQAIALAMQGILTPRPLTHDLLRSLCENLGVEVNKVLVQDIRDGTYYAELYLRQGDREVVVDARPSDAIALALRTNAPLYITEKVAAYTLNVEDLVSEDQAEELQQMLTDIKPEVDKKHLH

SEQ ID NO: 9762 - protein, 165 aa, Syntrophobacter fumaroxidans MPOB
MFKEMKVTGLVMDPQTNTPILILRDVKDDTTLPIWIGLLEATSIATELEKIQFPRPMTHDLIRNFFNHLDVKVERIEVCDLRNNTYYALIYIRDRDRVSSIDARPSDAIAIALRTQAPIYVKEEVISKFQKSDESAKPVFDKENREKWSELLEGLNPEDFSKYKM

SEQ ID NO: 9763 - protein, 181 aa, Desulfovibrio vulgaris DP4
MVEMKVVGLSLDESTKAPILVLRREESDELLPIWIGAMEAMAISLALNNVDVPRPLTHDLLLHTLHALRAELVAVDLVDLREGTYFAELVLIAGGRQARVDCRPSDGIALALRAGVPILVREDVLRRAAEDRMRPMQDDSAVLRAPGDTTLGMTREQLDEPDEKELSDLLQSLDPETKYRM

SEQ ID NO: 9764 - protein, 166 aa, Geobacter uraniumreducens Rf4
MYHEMKIFGFALDAIAQMPVIILKDDAGENSVPIWISTQESVSLAVELISRDISFQSGRGDLLTVLMQQMGMRIEKIAIESLRDGVFAASVKFGGKSKKHLVDVRVSEAMMAALKYKLPVMVHEEVVKQAPMLDLNEGHFSRETDARRFVDFLENLDPAAMGKYPM

SEQ ID NO: 9765 - protein, 167 aa, Candidatus Desulfococcus oleovorans Hxd3
MLHKVDILGLALDQDSKTPILVLKTVDTQETIPIWIGLLEATAIASALQEVHFERPMTHDLFKNFIAMMHVDVERIEVCDLKENTFYARIYFASGDNEFSIDARPSDAVAMAVRFSAPVFVDEKVIAALKPDGGARTYEVKDKSEEGKKWAEYLASLSPDDFGKYKV

SEQ ID NO: 9766 - protein, 160 aa, Sulfurihydrogenibium YO3AOP1
MVEMEVQGITLDPITNMPVLLLKGKENDEILTIWIGVFEANSIAMYLESMTYPRPLTYDLFTNILNSLSTSVENIIIHTLKDNTYYASIILRDKEGRTVEIDARPSDAINIALRSRCPILVSEEVLAEANNGKKEKIDEEDLKEWIESLKPEDFEKNIEF

SEQ ID NO: 9767 - protein, 177 aa, Geobacter bemidjiensis Bem
MTETKMGEANMYLEMKVFGFALDAIAQMPVIILKDTEEKHAVPVWINAQDSVAFAAQFVGREAAARTRRKDVFTALVEQMEMTLSRIVIESLKDGAFTSSVRLLPREGEEIRLEVHVTEAMLLSLRYQQPVLVDPDVLAQVSTLDLKEDGLAGENNARRFVDFLDHMDPASMGKYPM

SEQ ID NO: 9768 - protein, 242 aa, Desulfovibrio vulgaris  Miyazaki F
MIEMKVVGLSLDDATKAPILVLRREAGEELLPIWIGAMEAMAISIALNSVDVPRPLTHDLLLNTLRSLGAQLVAVDVVDLRDGTYFAELDILLNGSRTRVDCRPSDAIALALRADVPIFVSEDVLRRAAEDRLRPNMDENAARRPTDAASAMAREETARRDVRRRAGQPPWADGEAGSPINVEQISRVREAMGDQRAAKHKADQATDPSADQATDRPRDQHDLEEQLAELLRSLDPETKYRM

SEQ ID NO: 9769 - protein, 204 aa, Desulfovibrio desulfuricans ATCC 27774
MVEMRVFGLTIDPQTKTPIVILREMEGETVLPVWVGAMEAMAVSLVLNKENLPRPLTHDLLLMALRALKAGLVKVEITDLKDGVFFALLVLQGPGGRVRVDCRPSDAIALAMRAEAPIMVNEDVLRRAAEAQEKAEQRLHEEVLSPVPDAATDMVRKAGARKEADMLHSRLLHGTVLSDDIDPEEERRFREMLRSLEPISRRKM

SEQ ID NO: 9770 - protein, 164 aa, Desulfomicrobium baculatum DSM 4028
MVDMMVFGLALDEDSQMPILILKDTSEDIIFPIWIGAMEAMSISMALNKVAVPRPMTHDLILTILEKMETRLVAVEIISIHEGTYYAELVLQGETGERRVDCRPSDSIALALRAQVPIRVSEEVIALNKTLQKGVFQEVVTGEDSDKWTDILSKYSLDDLKYKM

SEQ ID NO: 9771 - protein, 167 aa, Geobacter M21
MYLEMKVFGFALDAIAQMPVIILKDAEEKHAVPVWINAQDSVAFAAQFVGREAAARTRRKDVFTALVEQMEMTLSRIVLESLKDGVFTSSVRLLPREGEELRLEVHVTEAMLLSLRYQQPVLVDPEVLAQVSTLDLNEDGLAQENNARRFVDFLDHMDPASMGKYPM

SEQ ID NO: 9772 - protein, 164 aa, Desulfohalobium retbaense DSM 5692
MVEVEVFGLALDESSQIPLLILKDREEQHVLPIWIGVMEAVAISMTLNEVDMPRPMTHDLFLNTIDQMGGELQRVEVIDLREGTFYAELVVAYGETVKRVDSRPSDAVALALRATCPIFVHENVFEAVEKRKGKSYEVGVQEEEAEKWTDMLESLDLDDLKYKM

SEQ ID NO: 9773 - protein, 90 aa, Brucella suis 1330
MAPDTILRQALERLEKALNTLEEAVDLRLDKEGDFAEAEEEVQRMNADRSRLAQELDQSEARAERLEAANREVSRRLVTAMETIRAVLDR

SEQ ID NO: 9774 - protein, 111 aa, Nitrobacter winogradskyi Nb-255
MNDRPANRSASAEPPNGGGGTDIDAATRRLTAALDALERAVERRRDADRDEDELASRIQALGADRSRLADELDGSLVRTRKLERTNREIAEKLDTAIGAIKSVLEAAGEKP

SEQ ID NO: 9775 - protein, 111 aa, Rhodopseudomonas palustris HaA2
MTDRPVPGSISADQAPTEIVAATRRIAAALEALESAVERRAEADRDEDELASRIQALGADRSRLADELDGSLVRTRRLERTNREIAQRLDAAIGTIRAVLDTEPADEEEPS

SEQ ID NO: 9776 - protein, 104 aa, Rhodopseudomonas palustris BisB18
MTDRPPGSLAQTLSSDIAAATRRLQAALEALESAAERRSEADRDEDELASRIHALGIDRSRLADELDGSLVRSRKLERTNREIAEKLDAAIGTIRSVLDAEDPA

SEQ ID NO: 9777 - protein, 110 aa, Rhodopseudomonas palustris BisB5
MTDRPVSGSISADQAPTEIVAATRRLAAALEALESAVERRAEADRDEDELASRIQALGADRSRLADELDGSLVRTRKLERANREIAQRLDAAIGTIRAVLETEQADEEPS

SEQ ID NO: 9778 - protein, 110 aa, Nitrobacter hamburgensis X14
MNDRPANRSANSEPANSGAVEIDAATRRLTAALDALERAVERRREADRDEDELASRIQALGADRSRLADELDGALVRTRKLERANREIAQKLDAAIETIKSLLDAAGEKP

SEQ ID NO: 9779 - protein, 90 aa, Mesorhizobium BNC1
MSGEATLREVLIRLGKAIDSLEAASDARLERERDFSEAEAEVQRMGADRARLAQEIDKSEARAERLSEVNREVSRRLVAAMETIRAVLDR

SEQ ID NO: 9780 - protein, 97 aa, Maricaulis maris MCS10
MNVRADMPEDALEAVVARLDTAMSRVEGVARSMRERVRRAETAAIEARDADVDRANLADALDQARGREAVLQDAAQAASDALDTAITDLRDFLTEEG

SEQ ID NO: 9781 - protein, 105 aa, Bartonella bacilliformis KC583
MICFCEKMIKGEIVMNQETTALPEVLKKLDNALKTLETTIINHNILMDKHNEWEEEIQYMNADRNRLAQELDNSEARAERLKEANKEVSRRLITAMEAIRTLLDR

SEQ ID NO: 9782 - protein, 116 aa, Bradyrhizobium BTAi1
MNDHPANLAGQVEPGAADLEAATRRLMTALDALESAVERRREADRDEDELATRIQALGADRSRLADELDGSLMKTRRLERTNREIAERLDSAIGTIRAVLNGGDAQDKAHHDEDDE

SEQ ID NO: 9783 - protein, 139 aa, Brucella ovis
MNVLINPSFVAYRAGDYYYPCKDARPAGAIRCPELACELDQELALERIWMAPDTILRQALERLEKALNTLEEAVDLRLDKEGDFAEAEEEVQRMNADRSRLAQELDQSEARAERLEAANREVSRRLVTAMETIRAVLDR

SEQ ID NO: 9784 - protein, 89 aa, Sinorhizobium medicae WSM419
MPAKTVKAAIDELRNAVQSLEIAIDGRFDKERDLSEFEGEVRRVNEDRSRLAQELDQSQFRANRLEEVNREVSRRLVTAMETIRAVLDR

SEQ ID NO: 9785 - protein, 90 aa, Ochrobactrum anthropi ATCC 49188
MAPETTLRQVLERLEKALNTLEQAVDLRLDKEGDFAEAEEEVQRMNADRSRLAQELDQSEARAERLEAANREVSRRLVTAMETIRAVLDR

SEQ ID NO: 9786 - protein, 88 aa, Parvibaculum lavamentivorans DS-1
MSKLDASMDRFSSALDRLEATINRQVLRAQAAKRLQEEVETLKEDRAELAEELDQLKSEARRLNELNERASETLADAIEGIREVLAES

SEQ ID NO: 9787 - protein, 106 aa, Methylobacterium extorquens PA1
MARADTKAAQGRRQDGVGLEEALHRLDTALALLETAVARKLEAERSRGDRETEFALLEEDRVRLAAELDAAGARLARMNSTTGEVNRRLDRAIETVEDVLSGPSGR

SEQ ID NO: 9788 - protein, 94 aa, Methylobacterium radiotolerans JCM 2831
MADETETISIDDALSRLEAAITRLDAVVQHRLETDAQPDDRDAELALMDEDRARLAAALDAASARLAAVSATTGEVGHRLDRAIETVQDVLGRA

SEQ ID NO: 9789 - protein, 149 aa, Beijerinckia indica ATCC 9039
MHLSEELAESLKRIEAILDRLEAASERRLRQDQARGDIAAELRLMQDDRSRLAVELDQALARNEALANAQAEVSQRLQSVGTSLQTILARTEATVISSDEMSSVETPTLEALQVETLQVAASHGEAAHADTSPSERLVAPGGATPPERV

SEQ ID NO: 9790 - protein, 106 aa, Methylobacterium populi BJ001
MARADSKAGQTRAQEAGSLEEALHRLDTALALLETAVARKLEAERSRGDRETEFALLEEDRVRLAAELDAAGARLARMTSTTGEVNRRLDRAIETVEDVLSGPAGR

SEQ ID NO: 9791 - protein, 114 aa, Rhodopseudomonas palustris TIE 1
MTDRPAHGSIATDQAPAEIVAAARRLAAALEALESAVERRAEADRDEDELASRIQALGADRSRLADELDGALVRSRKLERVNREIAQRLDSAIDTIRHVLDTEAGDPQPAEEES

SEQ ID NO: 9792 - protein, 93 aa, Methylobacterium sp. 4-46
MSAAVDDALRRLDAAVALLDAAVTRRLDAERSRGDLEAELALMQEDRARLAAELDAALGQLAEAVAVTDDVEHRLGRAIGTVETVLTRNRAEG

SEQ ID NO: 9793 - protein, 90 aa, Rhizobium leguminosarum bv  trifolii WSM2304
MPTGKTMEAALNELRQAISSLENAVDMRVEREREQGEIEGEVRRVHADRSRLAQELDQAEFRANRLEEVNREVSRRLVTAMETIRAVLDR

SEQ ID NO: 9794 - protein, 95 aa, Methylocella silvestris BL2
MDIPQRLDDALKRLSASLEKLEAASDRRAKSDAMRANLEEELAVLQDDRSRLAVELDGAIARAVTLEGANEDIARRLKSANAAIRDILGEVENDQ

SEQ ID NO: 9795 - protein, 106 aa, Methylobacterium chloromethanicum CM4; identical to SEQ ID NO: 9787

SEQ ID NO: 9796 - protein, 93 aa, Methylobacterium nodulans ORS 2060
MSAAMEDALRRLEAAVALLDAGVTRRLDAERSRGDLEAELALMQEDRARLAAELDGALAQLAEAVAVTDDVEHRLGRAIGAVEGVLGRSRADG

SEQ ID NO: 9797 - protein, 89 aa, Agrobacterium vitis S4
MATDKAEAALGALKQAISGLENAIDMRLELQRANGEVEQEVKRVHIDRARLAQELDQSQFRANRLEEVNREVSRRLVTAMETIRAVLDR

SEQ ID NO: 9798 - protein, 91 aa, Rhizobium leguminosarum bv  trifolii WSM1325
MMPTGKTMEAALNELRQAISSLENAVDMRVERQREQGEIEGEVRRVHADRSRLAQELDQAEFRANRLEEVNREVSRRLVTAMETIRAVLDR

SEQ ID NO: 9799 - protein, 156 aa, Sphingopyxis alaskensis RB2256
MTEKRARKPFTGWHMTAILVAFFATVVAVNFTMARLAMSTFGGKVVENSYVASQQYNKLLARAEAQDQLGWTPTVTRDPDRRVRIDIRKDGEPLADLSVGATASHPLGRTPPLALRFVAAEDGGWRSVEPLAEGRQRLDIRISRGTDEARYRIDLK

SEQ ID NO: 9800 - protein, 169 aa, Rhodospirillum rubrum ATCC 11170
MSMAKARPRGWWYPYIFVGAFGVVLAVNLTLLYFATSTFNGLVTTTAFEEGVAYNREIAAARAQETLGWTAKAALEPRAGGVEGSWPADLVVSLTSAENQPLLRDLAVTAQIRRPTQAGFDQALTLTAGTDGRWHAPLVLPFAGQWEVRVVATRGQAVFRMRDRFVLTP

SEQ ID NO: 9801 - protein, 152 aa, Rhodobacter sphaeroides 2 4 1
MAEMTGRKVLAITVGAFGVIIAVNLLMAFKAISTFPGLEVDNPYVASQTFDVERASQQALGWTLVADYDEAAREISLRFTGADGRPAAVSALDVLVGRTTEASDDRQPEFVLRDGAFRAPQDLARGKWMLRVEATSPSGTAFRQRLDLFVED

SEQ ID NO: 9802 - protein, 152 aa, Rhodobacter sphaeroides ATCC 17029
MAEMTGRKVLAITVGAFGVIIAVNLLMAFKAISTFPGLEVDNPYVASQTFDVERASQQALGWTLVADYDEAAREISLRFTGADGRPAAVSTLDVLVGRTTEASDDRQPEFVLRDGAFRAPQDLARGKWMLRVDATSPSGTAFRQRLDLFVED

SEQ ID NO: 9803 - protein, 167 aa, Sinorhizobium medicae WSM419
MSTATKQCSPERGFTGWHMVAVMSLFFGTIISVNLVMAWNASRSWSGLVVENTYIASQQFNGKVAEGRAFQASGIKGRLTAGRDAVRYVLTRNGEPERQIDKVIAVFKRPVEEHEDLRVELHPRGEGVFVLGEELRAGQWIAAMTAMEGDAVVHRHTVRFIAEGRDK

SEQ ID NO: 9804 - protein, 165 aa, Ochrobactrum anthropi ATCC 49188
MSIKSKTSGTFTGWHMLGIMVAFFGVIIAVNLTMAYNAIHSWSGLVVKNTYVASQEFNDKAQTGKEQAALQWQSKPAFESGIFTWQLADRDGKAVAMTGGTVEFKRPVGDVHDTKVTLTVREPGVLTAPLELGEGAWIMEVNADAGLEDPYRHIIRVLVKDGRIL

SEQ ID NO: 9805 - protein, 172 aa, Xanthobacter autotrophicus Py2
MAHQDVAHADVPRRPRELTGRAVLLILLAFFGVVIVVNVIMARFAVATFAGVETESSYKAGLAFSAEHRAAEAQVARHWNVNVELASPGNEARVVTIRVLDPSGMPLSQLTPDGRFAHPTDARRDVDLDLKPLGDGRYRATAVAGPGQWDLVIDFAQGGERQFRSKNRVQLP

SEQ ID NO: 9806 - protein, 155 aa, Dinoroseobacter shibae DFL 12
MSKSQEKEFTGRHMLMVMLGAFGVIITVNLTMAYNAIGTFPGLEVKNSYVASQNFDKNRASQQALGWTTDVRLDDGVLHLVFTDKQGQPVRAELLSVTLGRSTHVRDDQTPPFRWTGRDFTAPVDLDGGNWNIRLVAQAEDGTQFRQRMVFYVKG

SEQ ID NO: 9807 - protein, 166 aa, Rhodopseudomonas palustris TIE 1
MSRSKSSPRPLTGKVVLAVLVAFFGIVFGVNGLMMTLAIKTLPGTEVDSAYAASLAYEREIAAARDQDQRGWKVEAKVERKPDGAAVLQVEARDKAGLPLAGLNFFGRLERPSDKRYDREVALAEVGSGVYRGDADGVLPGRWDLVLEGDQGGVRMFLSKNKLLLN

SEQ ID NO: 9808 - protein, 166 aa, Methylobacterium sp. 4-46
MASTMSPPGAPLTGRRVLMIGLLFFGTVAAANAFLVTSALRTWSGLDEKSPYHAGQVYNAEIRLARAQAERGWHFAAEVARAGAGVAVTARLSDRAEAPLPGLRVEARLERPTDKRQDVVLPLSEARPGTYAGRAEAVPPGQWDLVVDAADATGRVFRRRSRLVLD

SEQ ID NO: 9809 - protein, 169 aa, Methylocella silvestris BL2
MSKRDLSFPEIRGPLTGWMVFAMTLAAFGVVFAVNGLMAYYAVSTFTGLADPSPYEHGLAYEKDILAAKAQDALGWDVSAHLTRDASGKEAIEARFKDRGGAPVPGLAVSAGFDSPADIKLDADLTLKEIEPGVYLGLVAARPGQWDLLIDARRDGERVFKSNNRVEIR

SEQ ID NO: 9810 - protein, 164 aa, Agrobacterium vitis S4
MSADSPKTFTFTGWHMLATICSFFGVIITVNLTMAWYAGHSWSGMVVQNTYVASQQFNDTTAQIRKLLDTGIQGTMTIKQGAIAYDLAIPGKGPVIADQVVANFKRPVGEHQDFTVMLKPAGPGHFTGDHPVDDGHWIVETIATRDGQLVMHEANRMAVIGGEK

SEQ ID NO: 9811 - protein, 161 aa, Rhizobium leguminosarum bv  trifolii WSM1325
MKTSAQGFTGLHMLLATSAFFGVVIAVNVTMAFYASSSWSGLVVENTYVASQEFNRKAAAMKAMAASGIEGNLSIKGHEIRYDIHDKRGSPAIVDDVVLNFKRPVGDHEDFLLTLKKAAAGRFEAEHDLAEGDWIVEAISRNGGVVVMHEAKRIDSAELDQ

SEQ ID NO: 9812 - protein, 116 aa, Methanosarcina barkeri fusaro
MVSKQPRKQRKARYNAPLHVRQKFMGARLSEALSKEYGTRSAAVIAGDTVKVMRGDYKGTEGKVQAVSLQDGTISVDGVISTKVDGTEVPRPIYPSNVMITKLELKDERRASSIKK

SEQ ID NO: 9813 - protein, 120 aa, Methanospirillum hungatei JF-1
MVRVISSQPRKQRKARYNAPHHMRGSLLHAALSKELQGKYKRRSIRVIKGDTVKVLRGDHAGTEGLVDYVITRDARIVVDGVSVKKADGTEVPRPVDPSNVMITDLNLEDKRREQKLSGE

SEQ ID NO: 9814 - protein, 117 aa, Methanococcoides burtonii DSM 6242
MVSKQPRKQRKARYEAPLHMKQKYMAAPLSKALRGKYGRSANVIVGDTVIVMRGDHAGTKGKVEALSLKSGTIVVEGVSVSKVDGTEVPRPIYPSNVMITSLEMNDKHRDSILSRGR

SEQ ID NO: 9815 - protein, 116 aa, Methanosaeta thermophila PT
MVSKQPRKQRKARFNAPLHMRQRFMHAMLSPELRKEYKKRSAQVKKGDTVKVMRGDNAGVEGEVLSVDLKRCVITVAGVSNFRADGTEVPRPIHPSNVMITKLDLDDDEREKIFSR

SEQ ID NO: 9816 - protein, 131 aa, Thermofilum pendens Hrk 5
MVKGTSSKPGKVRKREVYDAPLHIRSKKIVAPLSAELQQKLGIKRIRVRKGDRVLIVRGSFKGHEGKVTSVDVKKGRIHVEGATLRKADGTEVPFPIHPSKVVVTELDLSDPRRKELVERKKQVVVSGQEG

SEQ ID NO: 9817 - protein, 123 aa, Pyrobaculum islandicum DSM 4184
MPFTTSIQPRRQRLSLYTAPLHLRHKLFNAKLSPDLQKKLGVKRLPVRRGDTVMIMRGDFKGVTGKVVKVDLKKVRIYVEGATRTNSKGQTVYYPIHPSKVMIIDIDTSDKIRQKIIQRRKKE

SEQ ID NO: 9818 - protein, 121 aa, Methanocorpusculum labreanum Z
MARISSTQPRKQRKFRYNAPIHTRGAFLHSPLASDLREKYGKRSFRVVTGDTVKVLRGEFKGIEGVVDGVDVKNTKVLVHGVYVKKANGEDVPRPLDPSKIMITKLNTKDAVRVARLEVKA

SEQ ID NO: 9819 - protein, 121 aa, Methanoculleus marisnigri JR1
MVRIVSKQPRKQRKARYNAPNHTRGRFLSAALSPELRGKYNSRRTRVVKGDTVKVLRGDFAGDEGVVDAVDMKACRLVVHGVMVTKADGTEVPRPVDPSNVQITKLNLKDKLREERLGGGA

SEQ ID NO: 9820 - protein, 128 aa, Pyrobaculum calidifontis JCM 11548
MPFTASAQPRKQRLSLYAAPLHLRRKLLNAKLSPELQKKLGVKRLPVRRGDTVLIMRGDFKGVTGKVVKVDLKRVRIFVEGATRTNSRGQTVYYPIHPSKVMIVDVDLSDKARQKLIERRKRGQHGSS

SEQ ID NO: 9821 - protein, 119 aa, Methanococcus maripaludis C5
MVLTNSKQPRKQRKALYNAPLHLRNSVMAAMLSKELKEKFNKNSLPVKKGDTVKVLRGNFKGIEGEVSKVDYAGYKIIVEGVVNKKQDGTETAYPIHPSNVMITKLDESDEKRFKNSSN

SEQ ID NO: 9822 - protein, 122 aa, Pyrobaculum arsenaticum DSM 13514
MPITTSAQPRKQRLALFNAPLHLRHKLFNAKLSPELEKKLGVKRLPVRRGDTVMILRGDFKGVTGKVVRVDLKKVRIYVEGATRTNSRGQTVYYPIHPSKVMIVDVDMSDKARQKIIERRKK

SEQ ID NO: 9823 - protein, 111 aa, Metallosphaera sedula DSM 5348
MVSSKLIAPLSDELAKEYGMKRIGIRKDDTVRVMRGDNYGFEGKVTQVFPESGRIAIEGLTRKKADGTPVYIKIHASKVEITKLNTNDPRRKDIINRKASRQKEEQGGKAQ

SEQ ID NO: 9824 - protein, 119 aa, Methanococcus vannielii SB
MVLTNSKQPRKQRKALYNAPLHLRNSVMSAMLSKALKEKYGKNALPVKKGDTVKVLRGSFKGIEGEVSKVNYSGYKIIVEGVVNKKQDGKETPYPIHPSNVMITKMEDSDEKRFKTSNK

SEQ ID NO: 9825 - protein, 119 aa, Methanococcus aeolicus Nankai-3
MVLTTSKQPRKQRKALYNAPLHARNKLMSAMLSKDLKEKYNKNALPVKTGDTVKILRGTFKGIEGEVSKVDYKSYKIYVEGAVNRKQDGNESLYPIHPSNVMIVKMDDSDDRRFKFSNK

SEQ ID NO: 9826 - protein, 119 aa, Methanococcus maripaludis C7; identical to SEQ ID NO: 9821

SEQ ID NO: 9827 - protein, 121 aa, Candidatus Methanoregula boonei 6A8
MVRIESSQPRKQRKARYDAPSHMRSKFLNAPLSATLRETYEKKTIRVIKGDTVKVTRGDHVGEEGIVDGIDTRNVKIIVHGVSSTKVDGTEVPRPIDASKVEITKLKLDDKRRVEKLGGKE

SEQ ID NO: 9828 - protein, 143 aa, Caldivirga maquilingensis IC-167
MPVLTSSSQPRKQHKALTKAPWHARRRLLTAPLSKDLQRQLGIRRIPVRVGDTVLILRGDFKGTRGKVTRVDYKRVRIYVDSASFKKPSGEAVYYPIHPSKVVIVELDQSDKARVAAIDKTRKAREAKAGVREVITPQQGGQS

SEQ ID NO: 9829 - protein, 119 aa, Methanococcus maripaludis C6
MVLTNSKQPRKQRKALYNAPLHLRNSVMAAMLSKELKEKFNKNSLPVKKGDTVKVLRGNFKGIEGEVSKVDYAGYKIIVEGVVNKKQDGTETAYPIHPSNVMITKMDESDEKRFKNSSN

SEQ ID NO: 9830 - protein, 168 aa, Nitrosopumilus maritimus SCM1
MKPTKMRNKMIYRASYQTKSKQLGSALSKDLQKKYGKRSVRVNEGDSVTILRGEFKGVDGKVAEVSTAKSSVAIEGVKKEKTKGDKFDVFIHTSNLLVTSLNTEDKWRIAKLEGKDPRKQPKEAPKAAEKPAKEEPKKETPKAEEKPAKEEPKETKVEKKSEEKEDEN

SEQ ID NO: 9831 - protein, 122 aa, Thermoproteus neutrophilus V24Sta
MPFTTSAQPRKQRLSLYKAPLHLRHKLLNAKLSPELSKKLGVKRLPVRRGDTVLILRGDFKGVTGKVVRVDLKRVRIYVEGATRTNSKGQTVYYPIHPSKVMIVEADTSDKVRQKLLERRKR

SEQ ID NO: 9832 - protein, 118 aa, Halorubrum lacusprofundi ATCC 49239
MTKQPRKQRKRSETAPLHERQNQVRATLTDELREEYGQRNVRVNAGDTVEVLRGDAAGTEAEVISVDLSAERITVEDVTVEKADGEEVPRPIPASNVRVAELDLEDERREARLQEDNE

SEQ ID NO: 9833 - protein, 119 aa, Halorhabdus utahensis DSM 12940
MSEQPTKQRNQTERAPLHERHDQVHATLTEDLREEYGQRRVRVNAGDTVEVMRGDFAGEEGEVLDVDLRDATISVEDVTLETADGEEVPRRLEASNVRVIDLDLSDDVREQRLESEDSA

SEQ ID NO: 9834 - protein, 122 aa, Candidatus Methanosphaerula palustris E1 9c
MVRIASKQPRKQRKARYDATQHQRSAMLGAPLAPALREKYDGKRTLRVVTGDTVKVLRGDFIGEEGVVDGVDTRTSKIIVHGVSVTKADGTEVPRKVDPSNVQIIKLNLKDPRRAAKLGEVA

SEQ ID NO: 9835 - protein, 120 aa, Halomicrobium mukohataei DSM 12286
MTRQPSKQRKNARRAPLHEKQKQVRATLADDLREEYDQRSVRVNAGDTVEVLRGDYAGEEGEVVEVDLDDAAIYVEDVTVAAADGEDVPRPLDASNVRVTELDLDDDRREARLESEEDSA

SEQ ID NO: 9836 - protein, 91 aa, Moorella thermoacetica ATCC 39073
MPQAEGQVAAQDRTTVNINGQDYVVKGEAPEYIQMLAAYVDKKMRQVNQKFPHYSPVKVAVLAALNIADELYKVQQDYDTLVKLIQEEKQG

SEQ ID NO: 9837 - protein, 89 aa, Candidatus Desulforudis audaxviator MP104C
MAGQTNRVEVEIFGERYVLRGDRPPDYIRFIAQDVDRRVRDICNRHSRIPVTTAAVLAAVNLADELKRLQESYDGLVKMIEGEDKEKKK

SEQ ID NO: 9838 - protein, 100 aa, Natranaerobius thermophilus JW NM WN LF
MGVKGVARLRSDRRHRIEVNIFGEEYTLKSSSNPEHMKKVASVVDETMNKIAESKPRISLHQIAVLAALNLADEYLKLEDEHTDLLEMLDEKGETDKGDN

SEQ ID NO: 9839 - protein, 85 aa, Desulfitobacterium hafniense DCB 2
MAEENEKVIVEIFGEKHVIRGQESPEHILKVAREVDKKMRLIAQRTPRLAIHQIAILAALNLADELEKIKEEQETLMQLIEAQEE

SEQ ID NO: 9840 - protein, 120 aa, Halothermothrix orenii H 168
MPTGDKSSKGKAKKYKVNVLGEEMTVVADVTEEYIDKLIEYINDIGEAITRAYPGLPRRRITGLTLINMADEYYKLKKVYRDRIKEINNLREENKKLQNKINEMEIEQKELISLLEEVDQ

SEQ ID NO: 9841 - protein, 102 aa, Desulfotomaculum acetoxidans DSM 771
MPEEPNRVNIEIYGEEYILKGNESIEYMKKIAQHVNKMMKDISNRNFKLPLNKVAILAAINIADDYFKLMRKYEELTHENQELIEELTNPEPVKDNKKGVIK

SEQ ID NO: 9842 - protein, 95 aa, Alicyclobacillus acidocaldarius DSM 446
MDNNQEGAKVNRVKVVIHGVEYTVRGTSPEERIQEVAKMVDRTMNEIAATASYMDERRIAVLAALNLADELYELRKDYKELLALLEEQTGGRSSS

SEQ ID NO: 9843 - protein, 92 aa, Syntrophomonas wolfei Goettingen
MRLVKIYYHSKEEEIPLSWLNLHPDLLKIMEEMGIIELAGDSIKADGLQKIYKMMRLKNLLGVNFNGAAIIVDLLERIEELEDEIEELKRKR

SEQ ID NO: 9844 - protein, 110 aa, Syntrophobacter fumaroxidans MPOB
MVEKRYFMINVKTVTSSSPFLTRNELAVHCGIHPDLIDRFIRLGLIDFMDRDSDGEAVFSAEVIPLVRRILRLRNELGVNYAGIGVVLELMARVETLENHIKELESRIFA

SEQ ID NO: 9845 - protein, 104 aa, Frankia EAN1pec
MTMTLVRTRPRDRELDLESFCAAAQLHPDLVHRLVTLGLLDAGPGPGVGGRSVVLAAGALARVGRIERLRRDLGITYTATGVVLDLLDRIDELERLLRQPQRGR

SEQ ID NO: 9846 - protein, 100 aa, Geobacter lovleyi SZ
MTVQHYEIIISRKHELVSVPGITIHELSRLCDCHLTVARRLFSIGLIEPLTAGDTPLFDQSAVVRARKALRLKRDLRLNFDAIALVMDLLDRIDELERRI

SEQ ID NO: 9847 - protein, 103 aa, Micrococcus luteus NCTC 2665
MTSRHLPVRVARADLAATAVAAGIHPDTLRKFVELGLVTAHVDTSGRLWFARTVPARVHTIVRLHSDLAVNYAGIALVLDLLARIEQLEQHRTIRLEGDIPWT

SEQ ID NO: 9848 - protein, 122 aa, Catenulispora acidiphila DSM 44928
MTPANDIGQPGGGRRYPLVVVRRASQGRLTLEDVAGRSGVTSQLIRRFVALSVLDAQRDDAGQLWFDARAPATVARALRLHAGLGLNYASLGLVLDLLDRIDQLESALRRSGRPAKEFPPWT

SEQ ID NO: 9849 - protein, 106 aa, Nakamurella multipartita DSM 44233
MTAVTHFALARPYRLSLDSFAQATGVHPELVRRLVALGLLEVTRDAQGRLWFDPSQVREMARIQRLRMSLNLGYSAIGLVVELLDRIAVLEKEQRRMSRRGGVPWT

SEQ ID NO: 9850 - protein, 258 aa, Syntrophomonas wolfei Goettingen
MKIIATTTQSQTTLCSEYKQFLEETGLPFIPRERRSLQAIAQEQEAQAVLVWQASGPVLHMGDESFFFHPSMAKNRIASYRKLGTADPLIKACALEVGSSFLDCTLGLGADSIVAAYYAHEGRVAGLESSPLIAAIVKWGMKVYHSNMSWLDQAIHSIQVVNAEHYDYLRKLEDNSFDIVYFDPMFRKPRHKSTALAPLRLLANHQALSREVIAEACRVARKRVVVKEMPVSREFERLGIEQLMENPNNPIAFGVIEV

SEQ ID NO: 9851 - protein, 265 aa, Desulfotomaculum reducens MI-1
MNDSLVITTGIRSRKNLEEKALELSREWKIPYQPREKYSLDFIREMTGASTILLVSHQKLSLVTNGKEFFFHPGLAKLRIKELQAGKTDQMIKAMDLQEGDSLLDCTLGLAADALVASYVVGTKGIIVGLEDAAPVAHIIARGLRSYTGEKPELINAMRRIQVVNQHHLHYLRNLPSNTFDVVYFDPMFRVPKVKSSSMAPLRDLANSSPLSIEAVAEAVRVARKRVVMKENRESQEFQRLNFQLIQGGRYSPVAYGVIKGGVLK

SEQ ID NO: 9852 - protein, 254 aa, Thermotoga petrophila RKU-1
MKNFVVTTSHKPDREQVMKAKELAEKLGTIYVSRRRLKEFKVDFYYVVEKNRISIKWPGGEFFFHPSSAILRMRNIRSGQKDYLIESLQPEGNEIVLDTTFGLGSEAILMAAFLPEGKVIGLEGSIHIYTIVKYGMENFETDIQWLKDALKRIELYHANFKEYIRSQPDNSFDVVYCDPMFENPVYESSAMNPLRPFAVYDTVNEEDIEEMLRIAKKKVILKSHVKDSLFKRIRVDELKGSRKSGVLYGVIYKR

SEQ ID NO: 9853 - protein, 256 aa, Petrotoga mobilis SJ95
MVKNSTKWIFTTSHKPNKKQVEKALQLANKYGGVYLERNKLRMNEGDFYFVIDKKLSLNFQWEDGKLFFHPSVSKIRLNNYLKNGIDHLINAVSPKKNDIILDLTLGLGSDALLLSYFCEKVVGLEASFPIYAVVAENITNYDYKENWMKEASKKIEVINSDYKIFLDEQKEGSYDVVYCDPMFENPQYKSSSINPLRKFARYDKITREDLEKMIKIAKKKVVIKARSNDSVWDLYSFDKKIGSKKSGVFFGVIEK

SEQ ID NO: 9854 - protein, 267 aa, Candidatus Desulforudis audaxviator MP104C
MSHAVSILVTTSIRPRRAQRLQAEEISRTLGLPYVSRSRESLEALRRKSGAEAVVVVSRNRVGLVFAGREFFFHPGLGKVRIRRIEAGKTDQMIQAMGLKAGDSVLDCTLGLGADALVASHVVGAGGRVVGLEVVPVVAMLVRCGLENYAGGGPPAEAMRRVEVVTADHREYLQALENDSFDVVYFDPMFRVPRHASSAMEPLRPLADARALDPESVGEAVRVARRRVVLKERAGSPEFERLGFRRITGGRYSPVAYGIIAKDGDEA

SEQ ID NO: 9855 - protein, 254 aa, Thermotoga RQ2
MRNFVVTTSHKPDREQVMKAKELAEKLGTIYVSRRRLKEFKVDFYYVVEKNRISIKWPGGEFFFHPSSAILRMRNIRSGQKDYLIESLQPEGSELVLDTTFGLGSEAILMAAFLPEGKVIGLEGSIHIYTVVKYGMENFETDIQWLKDALKRIELYHANFKEYIRSQPDNSFDVVYCDPMFENPVYESSAMNPLRPFAVYDTVNEEDIEEMLRIAKKKVILKSHVKDSLFKRIRVDELKGSRKSGVLYGVIHKR

SEQ ID NO: 9856 - protein, 279 aa, Desulfitobacterium hafniense DCB 2
MNHATVIVNITHPRDPDLQKKFLWFSEQPGITLLTSSPKSLAGAVEEPPYPILHITRKGIYLETGDHPLHFHPSMALLRVMQIIRGEGDRFLEAVDLRAGDVFLDATFGLGTDALVAAVQVGAQGKVIGIEHSPILAALVKDGLRTLAQGDCPRVQNPDKAKAWQVLAEAAQRIEVLWGDHLELLAGYPAAFADVVYFDPMFRHTREKSASIRPLHEVANSCSLQGETVAEACRVAKRRVVLKERKASREFSRLGFEIQEGGNYSHVDYGIIHKEGAGS

SEQ ID NO: 9857 - protein, 247 aa, Desulfotomaculum acetoxidans DSM 771
MLLAERFCKELGYPLVPREKLSLPALIDKYQVAGVIVAAPDKVFYYTGEEEFFFHPNMAAVRIKDIRSGKTDQMVKAMDLRPGDSVLDCTLGFGADAIVSAFVTGTSGTVLGLEVSPVIAALVRYGIKNYNFKSKLLSSTMRNITVINASHYEYLLQTAANSFDIVYFDPMFRQPKYKSSNMTPLRKLADLSPLNRDVLVEALRVARKRVVVKERRGSSEFARLGIDRIEGGKYAPVVYGVKNKDND

SEQ ID NO: 9858 - protein, 266 aa, Alicyclobacillus acidocaldarius DSM 446
MTQACKTDMRILVTTPLHPKPAQVARASEMAAWFGGIAVPRRGQSIARLLADADAVVVVADPAVVHVRGVEHPLFFHPSMAYQRLRRLEQGEPDRLLALAGVSPGDVIVDATLGLGTDALVFAAAVGPEGSVVGIERSPVLYGLLRAVQAYGSEAHPREAALLKRVALVHGDHADWLRSQPDQSADVVYFDPMFREPVHQSAHMQPIRPVAWEAPLSREALEEAKRVARRAVIVKERPKSGVFEALGLEPDRTTGRFAYGVWRRPR

SEQ ID NO: 9859 - protein, 249 aa, Rhodoferax ferrireducens T118
MSGRVGEVRSLQPVFELSGASVHFGRAASPVRALSDVTMTVAPGERVALVGANGCGKSTLLRLLHGLALPTSGQLVSDPAWRQAMLFQKPHLMRLTVQANIALGLWLRGTPWGEAKVLALAALARVGLTELAQRNARQLSGGQQQRVAMARAWALRPQVLLLDEPTASLDPHAKREVEALIEEFSSGPDAMTLIFASHNLGQVKRLASRVIYLEHGRVLADLPVADFFGGSMLQQQYPAAHLFVKGELV

SEQ ID NO: 9860 - protein, 240 aa, Mesorhizobium BNC1
MRAAPSDLPLVLDGVSLAAGGTTILDRLNLTIMPGAPTLIVGPNGSGKTSLLRLCMGLAAPSKGTVSWGGRTHLPQTRRAIVFQKPVMLRRSAAANVAYGLAQAGCPRALRARRTEELLDRVGLLALASRPARRLSGGEQQRLALARALAREPEILLLDEPTASLDPAATRFVEEIILAAAQSGTKIVMASHDLGQVRRLAGDVLFLVRGRICERADAADFLDRPATPEAAAFVQGELVI

SEQ ID NO: 9861 - protein, 259 aa, Alkalilimnicola ehrlichei MLHE-1
MLQPVSDAGPGPESAGRVESALLPLELKGIGFRHRGQPLLQGVDLRIGGRGKTIVMGPNGAGKSLLMRICHGLLTPTEGELVWRGPRGGRAEERRRRQAMVFQRPVMLRRSALANVTFALAAQGYRRRQRRERAMAALTRFGLAPLARRPARVLSGGEQQRLALARAWALEPEVLFLDEPTAALDPAATKAVEEAVAGFDRRGTRIVMTTHDLGQARRLADEVVFICGGRLLERTPVADFFERPRSPEARAFTRGELVW

SEQ ID NO: 9862 - protein, 258 aa, Acidovorax sp. JS42
MSALPSPVFPGEESPGDVSTIEPPLFALRELSVRYGAVQALAGINLRVMPGERVALVGANGSGKSTLLRALHGLVRPSAGQLRRDGAPRVAMVFQRPFVLRTSALNNVALGLWLRRVRWQEACAQAAVALHRVGLQDIARQNARTLSGGQQQRLAFARAWALRPDVLLLDEPTASLDPHAKREIEALMADFAASHGSAGPQQPLTMLFSSHNLGQVKRLASRVIYLEHGRILADLPVHDFFNGPLPEAARLFVKGEIA

SEQ ID NO: 9863 - protein, 238 aa, Methylibium petroleiphilum PM1
MAEQALIALESVGLRYGALEALRAVNLSIVPGECVAFVGANGSGKSTLLRVLHGLLAPSAGVRRQREALDGRPLRFAMLFQRPFLFRLSVQANVRLGLWLGGVRGEEAKVRSAQALQRVGLAAEAARPARALSGGQQQRLALARAWALQPDVLLLDEPTASLDPSAKREVENLLAEFAMQGMTLLMASHNLGQVKRLAQRVVYLEHGRVLADVPAAQFFEGVALPPEAKLFLKGELPW

SEQ ID NO: 9864 - protein, 240 aa, Sinorhizobium medicae WSM419
MRAPASNLPLVFDDVSLSAGATTILDRICLTIGLGAPTLVLGPNGAGKTSLLRLCMGLLSPTRGVVSWGGRIDGGPERRAILFQKPVMLRRSVAANIAYGLAHAGCPRGLRAQRTEELLDSVGLSALASRPARRLSGGEQQRLALARALARQPEILLLDEPTASLDPAATRFVEEIILATAHSGTKIIMASHDLGQVRRLAGDVVFLVHGRLFEHADASDFFDRPATPQAAAFIRGDLVL

SEQ ID NO: 9865 - protein, 251 aa, Dinoroseobacter shibae DFL 12
MRDFHTHPELELGDKLLEARDIVLMRGGKRLLDGVDLSLPAGRRTVIMGANGAGKSLLLRVLHGLIAPDAGQVLWHGAPLSAEARQAQSMVLQRPVLLRRSVLGNLRFALSVRGIRGKERAAREAEALDRAGLSEFARRPARVLSGGEQQRLAVARALSTAPRMLLLDEPTASLDPAATRQIESQINAAHGAGVTVVMVTHDHGQARRMADDILFLHRGRVAEAGPAQQVLTAPRSAAVAAWLDGRFYDGP

SEQ ID NO: 9866 - protein, 238 aa, Methylobacterium extorquens PA1
MSAAPAIHLDGVSLALGGRVILDRLDIEIAAHGITALIGLNGAGKSVTLRVIDGLLRPDSGTVRLTPGRRAFVFQRPALVRASAAANVALGLVALKLSRRERAERIAAALARVGLSERANDAATRFSGGEQQRLALARAWAMQPDLLLLDEPTASLDPAATETIESLITEMARAGTTVLLVSHNLGQVARLADETVVLAAGRAVERGPTRSVLFSPRTPEARAYLTGELPWTAFAAAS

SEQ ID NO: 9867 - protein, 236 aa, Methylobacterium radiotolerans JCM 2831
MSAAPAIRLEDVTLSLDGRTVLDRLCLEVVSGSVTAVIGPNGAGKSVTLRVIDGLLRPDGGTVRVGPHRRAFVFQRPALIRATAAANVALALGSLPRPARAARVQEALARVRLAERARDAATRFSGGEQQRLALARAWAVGPDLLLLDEPTANLDPASTEIVEGLVSAMARAGTTVVLVSHNLGQVARLADTAIVLASGRAVEHGPSRQILFSPRTSEARAYLAGELPWTPSVVAS

SEQ ID NO: 9868 - protein, 238 aa, Methylobacterium populi BJ001
MSEPPAIHLQNVSLTRDGRTILDRLDLDVAAQGITAVIGPNGAGKSVTLRVIDGLIRPDAGTVRLSPGRRAFVFQRPALMRASARANVALGLVSLKLSRRERLERVDAALARVGLLERAADAATRFSGGEQQRLAFARAWAMRPDLLLLDEPTASLDPAATETIEGLITEMAGAGTAVLLVSHNLGQVARLADETVVLAAGRAVERGPTRSLLFSPRTVEARAYLTGELPWTSFAAAS

SEQ ID NO: 9869 - protein, 243 aa, Methylobacterium sp. 4-46
MSPALPILLDGLSFRAGGRTILDRVSLRIEEPGITALIGPNGAGKSVLLRLLDGLLPLSAGAVRIGPGGAPARRAFVFQRPGLVRASAGHNIRLALAAAGWRRAEARARCRAALALVGLADRARDPATRLSGGEQQRLALARAWAVAPDLLLLDEPTANLDPAAAERVEQVVAGMAREGVKVLLVSHHLGQVARLARDVVVLSGGRVAEHGPVSQVLTHPRAPETRAYLAGELPWTAFAACSA

SEQ ID NO: 9870 - protein, 238 aa, Methylobacterium chloromethanicum CM4
MSAAPAIHLDGVSLTLGGRVILDRLDLDVAAHGITALIGPNGAGKSVTLRVIDGLLRPDSGTVRLTPGRRAFVFQRPALVRASAAANVALGLVALKLSRRERAERIAAALARVGLSERANDAATRFSGGEQQRLALARAWAMRPDLLLLDEPTASLDPAATETIESLITEMARTGTTVLLVSHNLGQVARLADETVVLAAGRAVERGPTRSVLFSPRTPEARAYLTGELPWTAFAAAS

SEQ ID NO: 9871 - protein, 244 aa, Methylobacterium nodulans ORS 2060
MSPGLPVLLDGVSFRAGGRAILDGVSLRIEEPGITAIIGPNGAGKSVLLRLLDGLLAPSQGRIRIGRGEGGAVRRAFVFQRPGLIRASAARNVRLALGPAGLPRAEQAARIAAALALVGLADRAGDPATKLSGGEQQRLALARAWAVAPDLLLLDEPTANLDPAATEAVERVIAAMARAGTKVLLVSHHLGQVARLARDVVVLSEGRVVEHGPARQVLSDPRSPETRAYLAGELPWTAFAACSA

SEQ ID NO: 9872 - protein, 258 aa, Diaphorobacter TPSY uid29975
MSALPSPVFPGEESPGDVSTIEPPLFALRELSVRYGAVQALAGVNLRVMPGERVALVGANGSGKSTLLRALHGLVRPSAGQLRRDGAPRVAMVFQRPFVLRTSALNNVALGLWLRRVRWQEACAQAAVALHRVGLQDIARQNARTLSGGQQQRLAFARAWALRPDVLLLDEPTASLDPHAKREIESLMADFAASHGSAGPDQPVTMLFSSHNLGQVKRLASRVLYLEHGRVLADLPVHDFFNGPLPEAARLFVKGEMA

SEQ ID NO: 9873 - protein, 239 aa, Variovorax paradoxus S110
MNEHAQLASADATVFALYGVDVRLGRVAALHGATLTIAAGERVALIGANGSGKTTLLRLLHGLVPHAAGSFTSAAPRRQQAMLFQRPHMLRASVTVNVALALWLRGMRWRDARRAAIPALARVGLEDLAERNARALSGGQQQRVALARAWALHPAVLLLDEPTASLDPTAKREVETLIAEAAAGRTLVFASHNLGQVKRLASRVVYLEHGRVLADLPVHDFFHGPLPEEARLFVKGELA

SEQ ID NO: 9874 - protein, 134 aa, Mycobacterium MCS
MMSLESKPGADASLGELMSQLSAQTSRLVRDELRLAQKEFQESAKHAGIGAGLLSVAGLFAVLGLATVIAAAVAALSLVLPVWAAALIVALVLFVIAGIAALVSKKQADEVTPAAPRTVETVKADIQEVKDRAS

SEQ ID NO: 9875 - protein, 133 aa, Nocardioides JS614
MTDPRTTTDEPVGALVHRLSEQIPELVRTELRLAQAELAQKGKRAGLGIGMFSLAGLLAFLATATLVATAVIALDLVLPLWAAGLIVAGVLLIGALGAGLGGRSEIQQATPPTPEVTIANVKEDVATLKGERR

SEQ ID NO: 9876 - protein, 134 aa, Mycobacterium KMS; identical to SEQ ID NO: 9874

SEQ ID NO: 9877 - protein, 134 aa, Mycobacterium vanbaalenii PYR-1
MTHSKTEPSMGELVSQLSEQTSRLVRDEMRLAQKEMQESAKHAGLGAGMVGAAALLSVLGLATLIAGAVAALALALPVWLSAVIVAVVVFAAAGIAALVGKKQAEQVPPPAAQSVDSVKSDIDEIKVARHGSRT

SEQ ID NO: 9878 - protein, 134 aa, Mycobacterium JLS
MMSLESKPGADASLGELMSQLSAQTSRLVRDELRLAQKEFQESAKHAGIGAGLLSVAGLFAFLGLATVIAAAVAALSLVLPVWAAALIVALVLFVIAGIAALVSKKQADEVTPAAPRTVETVKADIQEVKDRAS

SEQ ID NO: 9879 - protein, 151 aa, Salinispora tropica CNB-440
MADVANARPTQAGSEPSTAELVQRATEQVSRLVRDELTLARAELAQKGKHAGIGIGLFGGAGVLALYGLGALAATVILLLALVVPAWVAALIVAVVLFVAAGVLALVGKKQVTQAVPPVPAGTVRSVRADVDTVTAAVKDGRAAVQDGRRA

SEQ ID NO: 9880 - protein, 151 aa, Salinispora arenicola CNS-205
MADVANVRTTQAGSDPSTAELVQRATEQVSRLVRDELALARVELAQKGKRAGIGIGLFGGAAALALYGLGALAATVILLLALIMPGWVAALIVAVVLFVAAGVLALVGKKQVGQAVPPVPEGTVRSVRADVDTVAAAVKDGRAVARDGRRV

SEQ ID NO: 9881 - protein, 137 aa, Actinosynnema mirum DSM 43827
MEQVTAATDRADPSTGELVGRLSEQVSRLAREEIRLAVLEVQEKGKKAGRGAGLLGGAGVLAWFGVMALVAALILGLAQVMPAWGAALVVAGGVFVVAGALALIGRGQLRRAAPPIPEQAVAGVKRDLAAVSERAHR

SEQ ID NO: 9882 - protein, 138 aa, Brachybacterium faecium DSM 4810
MPRRERPVSTSPSPEETSIADLVDRLSAQTSRLVRDELKLARAEYAEKAKQGGTAAGLFGAGAVLAWFGVGALLATLILVLSLVLPAWAAALIVTAVVFAAAGIAALLGKKTTEGLTATPERTLETVRRDATEIKERI

SEQ ID NO: 9883 - protein, 135 aa, Catenulispora acidiphila DSM 44928
MSIDDRRETHADEHLATLLTQAAHQFGQLARDELQTARAEFARNRRTLGFGGGLIGGAGVLAFVAVQAVAAAVIAALALAMPVWLAALIVGVAAGLTAAVLALVGKKQVGRVVPVVEETVDSVKADVAVIKEGGR

SEQ ID NO: 9884 - protein, 137 aa, Saccharomonospora viridis DSM 43017
MVYDDRREALRQRSVAELVNDLSAQTSRLVRNELWLARAEMQAKGKRFGLGAGMAGAAGVIALFATGVLIAAAVLALALVLPAWAAALVVGVALLLFAGGLALLGRGQVRRGSPPVPREAIESVRSDIAAVREKMRQ

SEQ ID NO: 9885 - protein, 110 aa, Escherichia coli BL21 (DE3)
MYEALLVVFLIVAIGLVGLIMLQQGKGADMGASFGAGASATLFGSSGSGNFMTRMTALLATLFFIISLVLGNINSNKTNKGSEWENLSAPVKTEQTQPAAPAKPTSDIPN

SEQ ID NO: 9886 - protein, 92 aa, Baumannia cicadellinicola Homalodisca coagulata
MYHTLLVVFFLVAISLVALIILQQGPDDIDNSFGLGASKTLFGSSGSSNFITRMTAFMAAIFFLLCLLLSIICNNKKPVLNSINTTTNVVSE

SEQ ID NO: 9887 - protein, 107 aa, Psychromonas ingrahamii 37
MYEILLVVYLIVAIILIGFVLIQQGKGAGMGASFGSGSSNTVFGASGAGNFMTRTTAILAIVFFGLSLVLGNLSTNKVTADQKFSNLEVEKVIDVPVEKDTSGDIPE

SEQ ID NO: 9888 - protein, 172 aa, Enterobacter sp. 638
LPPDCPISVLLLFFSAVDTMHNCPCEGHSLWLVFTPASVGNKNPAKLVEALVCGKSARNRLIMYEALLVVFLIVAIALVALIMLQQGKGADMGASFGAGASGTLFGSSGSSNFMTRTTAILATLFFIISLALGNINSNKTSKGSEWENLNAPSKTEQTQPAEPAKPTSDIPQ

SEQ ID NO: 9889 - protein, 111 aa, Vibrio cholerae O395
MFTVLLVIYLLAAVAIIGLVLIQQGKGADMGASFGAGASNTVFGASGSGNFLTRMTAIFATVFFVISLVLGNMSTHKTESQWVDPSQGQVIQQAGDSVSEAPAKSSDEIPQ

SEQ ID NO: 9890 - protein, 111 aa, Yersinia pseudotuberculosis IP 31758
MYEALLVFFLLISIGLVALIMLQQGKGADMGASFGAGASATLFGSNGSGNFMTRMTAVLATLFFVISLILGNMSSNQGQKSSEWENLGQPLKTEQTATPVAPVKPSSDIPQ

SEQ ID NO: 9891 - protein, 112 aa, Vibrio harveyi ATCC BAA-1116
MFSVLLVIYLLAALGVIGLVLIQQGKGADMGASFGAGASNTVFGASGSGNFLTRTTAILATVFFIVSLLLGRMSTHKTESQWVDPTLGQPVVEQVKDAVSEVPAPTGDEIPQ

SEQ ID NO: 9892 - protein, 110 aa, Escherichia coli HS; identical to SEQ ID NO: 9885

SEQ ID NO: 9893 - protein, 110 aa, Escherichia coli E24377A; identical to SEQ ID NO: 9885

SEQ ID NO: 9894 - protein, 111 aa, Serratia proteamaculans 568
MYEALLVIFLLISIGLVALIMLQQGKGADMGASFGAGASGTLFGSSGSGNFMTRMTAVLATLFFVISLILGNLSTNQTKKGSEWENLGQPVKSEQTTAPAAPTKPSSDIPQ

SEQ ID NO: 9895 - protein, 111 aa, Yersinia pestis Angola; identical to SEQ ID NO: 9890

SEQ ID NO: 9896 - protein, 110 aa, Escherichia coli C ATCC 8739; identical to SEQ ID NO: 9885

SEQ ID NO: 9897 - protein, 111 aa, Yersinia pseudotuberculosis YPIII
MYEALLVFFLLISIGLVALIMLQQGKGADMGASFGAGASATLFGSNGSGNFMTRMTAVLATLFFVISLILGNMSSNQGQKSSEWENLGQPLKTEQTTTPVAPVKPSSDIPQ

SEQ ID NO: 9898 - protein, 110 aa, Escherichia coli SMS 3 5
MYEALLVVFLIVAIGLVGLIMLQQGKGADMGASFGAGASATLFGSSGSGNFMTRMTALLATLFFIISLVLGNINSNKTNKGSEWENLSAPAKTEQTQSAAPAKPTSDIPN

SEQ ID NO: 9899 - protein, 110 aa, Shigella boydii CDC 3083 94
MYEALLVVFLIVAIGLVGLIMLQQGKGADMGASFGAGASATLFGSSGSGNFMTRMTALLATLFFIISLVLGNINSNKTNKGSEWENLSAPAKTEQTQPAAPAKPTSDIPN

SEQ ID NO: 9900 - protein, 110 aa, Salmonella enterica serovar Newport SL254
MYEALLVVFLIVAIGLVGLIMLQQGKGADMGASFGAGASATLFGSSGSGNFMTRMTAVLATLFFIISLVLGNINSNKTNKGSEWENLSAPAKTEQTQPAAPAQPTSDIPR

SEQ ID NO: 9901 - protein, 110 aa, Salmonella enterica serovar Heidelberg SL476; identical to SEQ ID NO: 9900

SEQ ID NO: 9902 - protein, 110 aa, Salmonella enterica serovar Schwarzengrund CVM19633; identical to SEQ ID NO: 9900

SEQ ID NO: 9903 - protein, 110 aa, Salmonella enterica serovar Agona SL483; identical to SEQ ID NO: 9900

SEQ ID NO: 9904 - protein, 110 aa, Salmonella enterica serovar Dublin CT 02021853; identical to SEQ ID NO: 9900

SEQ ID NO: 9905 - protein, 110 aa, Aliivibrio salmonicida LFI1238
MHTILLVIYLIAAVGVIGLVLVQHGKGADMGASFGAGASNTVFGSGGSGNFLTRMTAICATVFFIISLALGNMSTHKSEGFDLKLDQQATEQVTDNVSDVPATENSDVPL

SEQ ID NO: 9906 - protein, 110 aa, Escherichia coli O157 H7 EC4115; identical to SEQ ID NO: 9899

SEQ ID NO: 9907 - protein, 129 aa, Azotobacter vinelandii DJ
MLETETIVIVFHLLAALGVIALVLIQQGKGAEAGASFGSGASATVFGSQGSSTFLSRVTAILATAFFLTSLGLGFLAKEKADSLSKVGLPDPAALEVQQKKPAAEDVPVLEERKPAGDAVDVPQAPEQK

SEQ ID NO: 9908 - protein, 135 aa, Dickeya dadantii Ech703
MDGRRLFRKNLNQFAFTAKDNTGTAMYEALLVIFLLVAISLIGLIMLQQGKGADMGASFGAGASATLFGSSGSGNFMTRMTALLATLFFVISLILGNLSSGHSKKSSEWENLSQPAKVEQVVPEKPATPSSDIPK

SEQ ID NO: 9909 - protein, 111 aa, Dickeya zeae Ech1591
MYEALLVIFLLVAIGLVGLIMLQQGKGADMGASFGAGASATLFGSSGSGNFMTRMTALFATLFFVLSLILGNMSSDHSKKGSGWDNLSQPVAPEKAEQSKAPAAPSSDIPK

SEQ ID NO: 9910 - protein, 110 aa, Pectobacterium carotovorum PC1
MYEALLVIFLLVSIGLVALIMLQQGKGADMGASFGAGASATLFGSSGSGNFMTRMTAILATLFFIISLVLGNLSSLQKKGGAWDNLNQPEKAEQTTTPAAPSTPASDIPK

SEQ ID NO: 9911 - protein, 54 aa, Bacillus cereus ATCC 10987
MAKKKSFPLRIDPELHAVIEKWANDEFRSVNAHIEYLLREMAKQKGKLKKDKDV

SEQ ID NO: 9912 - protein, 54 aa, Bacillus anthracis Ames 0581
MAKKKSFPLRIDPELHAVIEKWANDEFRSVNAHIEYLLREMAKQKGKLKKDKDA

SEQ ID NO: 9913 - protein, 54 aa, Bacillus anthracis str Sterne; identical to SEQ ID NO: 9912

SEQ ID NO: 9914 - protein, 66 aa, Colwellia psychrerythraea 34H
MAAKKSFPLRINPEVLAAMQRWSDDELRSVNAQIEYVLRKALVDSGRVKLIQKVVTIVEEADAVKK

SEQ ID NO: 9915 - protein, 76 aa, Thermobifida fusca YX
MASERKKILLRLDPAVYDALAKWASDELRSTNAQIEFLLRRALIDAGRMPQGVKAIPRRGRPRKQDTSPPADDSPS

SEQ ID NO: 9916 - protein, 70 aa, Novosphingobium aromaticivorans DSM 12444
MAAPPKKAFPLRIDPALFAAVERAAAADLRSANAQIEVLLREALTRRGVKLAAAEPARRGRPPRKENGNG

SEQ ID NO: 9917 - protein, 65 aa, Deinococcus geothermalis DSM 11300
MPRKHYPLRISPELYAALERWAADELRSVNAQIEYLLTQSVRQAGRWKAAPKAGEEARESEQQKE

SEQ ID NO: 9918 - protein, 69 aa, Sphingopyxis alaskensis RB2256
MTGSAKKAFALRLDPALFAAVERMAAADLRSANAEIEVLLREALARRGVPVKPPAPPRRGRPPKTDAQD

SEQ ID NO: 9919 - protein, 70 aa, Shewanella amazonensis SB2B
MTKKAYPLRINADVLAAMQRWADDELRSLNAQMEYVLREALVQSGRVKLVQKVVVEVQENDEPDSAENRE

SEQ ID NO: 9920 - protein, 65 aa, Sphingomonas wittichii RW1
MPARKAYPLRIDQPLFDAIERAAATDLRSVNAEIECLLREALARRGIRVAPAEKRPRGRPAVERD

SEQ ID NO: 9921 - protein, 52 aa, Bacillus cereus cytotoxis NVH 391-98
MAKKKSFPLRIDPELHAIIEKWANDEFRSVNAHIEYLLREMAKQKGKLKKEK

SEQ ID NO: 9922 - protein, 90 aa, Frankia EAN1pec
MAERKKILLRLDPAVHDALARWASDELRSTNAQIEFLLRAALADRGRLPREAGAIPRRGRPRRDTTTGPEPGPEDAPSTEAVDVRRTPPP

SEQ ID NO: 9923 - protein, 54 aa, Bacillus weihenstephanensis KBAB4; identical to SEQ ID NO: 9912

SEQ ID NO: 9924 - protein, 72 aa, Caulobacter K31
MAASPPEAPKGGRRAFLMRVRPDVLAAVEHLAAAELRSVNAQVEMLLREALSRRGALRVLDSGSASEEPPSP

SEQ ID NO: 9925 - protein, 72 aa, Opitutus terrae PB90 1
MSADPKKSFLLRMDPELWRELEAWAAAELRSVNGQVEYLLREAVRQRKGTPPPGNASAASSPDMSAEDRQRG

SEQ ID NO: 9926 - protein, 59 aa, Stenotrophomonas maltophilia R551 3
MSEKKAYPLRINAEVLAAAQRWADDELRSLNAQIEYVLRDALRKAGRLPKPKASPEDKE

SEQ ID NO: 9927 - protein, 93 aa, Alteromonas macleodii  Deep ecotype
MYLPRHSGVPQRTAAHKVFVLAKKKAYPLRINENVLAAMERWAADDLRSVNAQIEYVLRQALVSHGRVKLVEKVVVEVEDVDTSIHSDDSTQN

SEQ ID NO: 9928 - protein, 54 aa, Bacillus cereus AH187; identical to SEQ ID NO: 9911

SEQ ID NO: 9929 - protein, 54 aa, Bacillus cereus B4264; identical to SEQ ID NO: 9912

SEQ ID NO: 9930 - protein, 54 aa, Bacillus cereus G9842; identical to SEQ ID NO: 9912

SEQ ID NO: 9931 - protein, 54 aa, Bacillus cereus AH820; identical to SEQ ID NO: 9912

SEQ ID NO: 9932 - protein, 77 aa, Desulfitobacterium hafniense DCB 2
MSMSKKQFALRLDPKLYTALEKWAADEFRSVNSHIEFLLREATRKSGRLNKGGETPGEGGDYIDVNPHGRSSSHFSE

SEQ ID NO: 9933 - protein, 61 aa, Clostridium cellulolyticum H10
MAEKKTLLLRLSPKLWEEISKWAEDEFRSVNGQIEYIISEALRKRNKSAHKIVSDSEDAKD

SEQ ID NO: 9934 - protein, 87 aa, Actinosynnema mirum DSM 43827
MAERKSVLLRLDPAVHDALTRWANDDLRSTNAQIEFLLRRALAEAGRLPGGTGAPARRGRPRKAARKDGEPQEPDPTTPPEPPPRNE

SEQ ID NO: 9935 - protein, 63 aa, Geobacillus WCH70
MAKKKSFPLRIDPALYEVIERWAHDEFRSVNAHIEFLLREAAKRAGRLTQRKINTDKSTDERG

SEQ ID NO: 9936 - protein, 70 aa, Eggerthella lenta DSM 2243
MAKRKQYPLRIDSEVWAGIERWAADDLRSVNAQVEFILRRALKDAGRLKDEGGRQPGHPGRTGDEEAPAE

SEQ ID NO: 9937 - protein, 60 aa, Dyadobacter fermentans DSM 18053
MAEKKAFVLRINPDMLRELETWAQQDFRSLNGQIEFLLSEALKKQKRSKSKGSGGDGAKE

SEQ ID NO: 9938 - protein, 63 aa, Chitinophaga pinensis DSM 2588
MADKKTFVLRIDTQTYEAIEKWAADEFRSINGQLEWIIHRALKEAGRTVKTGPEKPPKKNDPA

SEQ ID NO: 9939 - protein, 96 aa, Catenulispora acidiphila DSM 44928
MSPRKQILLRLDASVHDALARWAGDELRSTTAQIEYVLRQALAQAGRLPDDVGKMPRRGRPPKGAAAGEAAHGDQAGDEDGQADRADQASPGPDQE

SEQ ID NO: 9940 - protein, 64 aa, Anaerococcus prevotii DSM 20548
MAKKQIPLRVSEKLYKQIAQWAEDDFRSINGQIEYLLTECVKQRKKDGKYVSETIDEPIDLDIE

SEQ ID NO: 9941 - protein, 66 aa, Atopobium parvulum DSM 20469
MAPRKQYPLRVAPEIWEAVERWAQDDMRSTNAQVEWILRDALKRAKRSPKANNTCMNKTEKMEEGN

SEQ ID NO: 9942 - protein, 62 aa, Desulfotomaculum acetoxidans DSM 771
MPPKKSFLLRIDPKLYEVLEKWSADEFRSVNAQIEYILRNAAGKAGRLPKKETAQILNEDKK

SEQ ID NO: 9943 - protein, 177 aa, Thermobifida fusca YX
MTVDGAKSAPPTKAARHAKITELLTKYAVRSQNELARLLAEEGVQVTQATLSRDLDELGAVKLRTVDGNLVYVLPGEGGERLPRAHADELELEQVSNPRLSRLAEDLLVSAEASANIVVVRTPPGAAQYLASAIDHSDIPAILGTIAGDDTILVVARDPQGGEELAATLLRFANRRV

SEQ ID NO: 9944 - protein, 148 aa, Chlorobium chlorochromatii CaD3
MNKQARHFKIREILQRHSVENQHDLLQLLREQGMSVAQATLSRDCAELGLMRVRVNGSYRMVVPDDNAGRIIKGLVGIEVLSINANETTVIIRTLPGRAHGVGSYLDQLKSPLVLGTIAGDDTVLVIPASVHNISSLIAYIHSNLSKT

SEQ ID NO: 9945 - protein, 234 aa, Frankia CcI3
MTSEAGAEAARAAPLTKHARQARLAALIGQRGVRSQTELARLLAAEGVQVTQATLSRDLEDIGATKVRGPDGGLVYAVEANLAPAEIVRLSLTRLCEELLVSAEANGDLVVLRTPSGAAQLFASVLDREALPGVMGTIAGDDTVLVVCRSAPAAEALVRPESSVRPESSVRPESSVRPESSVRPESSVGPGDPAGQGGHAGPRGPALAAHLLWLADGRARGASTGSSAVPDQDA

SEQ ID NO: 9946 - protein, 184 aa, Acidothermus cellulolyticus 11B
MTTATPGTKAARHARIRELLAARSIRSQHELAELLAAEGFLVTQATLSRDLEEIGAVRLRSVDGGFVYVVPSTEPPAASAAGRLARLAAELLISAEPSGNLVVVRTPPGGAHLLASAMDQAGLPDLLGTVAGDDTVLCVVRRPDGGAALARRLLDLAQRRGALTRARKRSASPHAGAEHEGEIR

SEQ ID NO: 9947 - protein, 161 aa, Mycobacterium gilvum PYR-GCK
MTAATTRAGRQARIVSLLSAQSVHSQTELAALLADEGIDVTQATLSRDLEELGAVKLRGADGGVGVYVVPEDGSPVRGVAGGTERVTRLLGDLLVSTDASGNLAVLRTPPGAAHYLASAMDRAALPYVVGTVAGDDTILVIAREPMTGAELAVTIENLAKT

SEQ ID NO: 9948 - protein, 172 aa, Salinispora tropica CNB-440
MTAPLTRAARHARIVELIRDKAIHSQTELGDLLAGDGIQATQATLSRDLKELGAVTVRGGDGRGVYLIPEDGQRPLREAETAPARLVRLLRELLNGVDASGNIAVLRTPPGAAQFLASALDRAGLPEVVGTIAGDDTILVVAREADGGAALGDQLAGWARREDNVERSTHHD

SEQ ID NO: 9949 - protein, 176 aa, Mycobacterium tuberculosis F11
MAAGALMSRAKAAPVAGPEVAANRAGRQARIVAILSSAQVRSQNELAALLAAEGIEVTQATLSRDLEELGAVKLRGADGGTGIYVVPEDGSPVRGVSGGTDRMARLLGELLVSTDDSGNLAVLRTPPGAAHYLASAIDRAALPQVVGTIAGDDTILVVAREPTTGAQLAGMFENLR

SEQ ID NO: 9950 - protein, 189 aa, Frankia EAN1pec
MTIRSAAPLTKHARQARLAALIAARSVRSQAELARLLAEEGVQVTQATLSRDLEDIGATKVRGANGALVYSVDVNLAPAETVRIPLARLCEELLVSAEANGDLVVLRTPPGAAQLFASALDRAALPEVMGTIAGDDTVLVVCRAGPTGPGGPAFAGRLLSLADGVARVAVPPGTGGHPGIGAGTGAGAG

SEQ ID NO: 9951 - protein, 148 aa, Chlorobium phaeobacteroides BS1
MSKQIRHRKIKEILLSSTVTNQHELILLLEKRGIDVAQATLSRDCSELGVLRSRTASGYRLMIPEDNPGQMIKGLVEMEIQSIESNESSIVIKTLPGRAHGVGSFIDHLKNPGILGTIAGDDTVLVIPSSVHDIRSILDYMQTNLLNN

SEQ ID NO: 9952 - protein, 184 aa, Beutenbergia cavernae DSM 12333
MSTTSPPTKTARHALIAQAITRAHIHSQGELLETLAADGVVVTQATLSRDLVELQAQKVRGPDGLVYALPPEGGAHALGPASSDAEQLSRRLERLCAELLVSAEASANLAVLRTPPGAAQFFASAIDHSVLPGVLGTIAGDDTVLVISRDPAGGADVADRFLTLAAGVQPEATTPTTSQQERSS

SEQ ID NO: 9953 - protein, 142 aa, Eggerthella lenta DSM 2243
MRKRQQRHDIIRDIIREHNVKTQRDLANQLQAAGYECTQATISRDIMDMGLVKSREGYYVLPEEMRLQRMVSELVEEVHVAGNMVVVKTFSGGAAGVSAALDKASLRGALGTVAGDNTIMIAAESPEAAVEVERAIDRLRRR

SEQ ID NO: 9954 - protein, 171 aa, Saccharomonospora viridis DSM 43017
MNRARRHARITELVSSMAIRSQTELARLLAAEGIEVTQATLSRDLDELGAVKLRGADSGAPVYVIPEDGSPVRGVQGGTARLSKLLAEFMVSADASGNLMVLRTPPGAAQFLASAIDRAALDEVVGSIAGDDTIAVIAREPLTGKELAERFTALAQRSSKADTNVSEEKNK

SEQ ID NO: 9955 - protein, 195 aa, Jonesia denitrificans DSM 20603
MVGEQLMSSTLPPTKAARHARIAHILTHQAIHSQAELARALEVDGLYVTQATLSRDLIELRAEKIRDARGGLIYRVTPEGAEQVRSSQRESETAIARLARLCAELLISAQSSGQLVVLRTPPGAAQFLGSAIDTSAMDGVMGTIAGDDTVLVITREDTNGTDIAQRFMVLAGDTTSDKNDDPQRSSAHETGSRTP

SEQ ID NO: 9956 - protein, 78 aa, Methanosarcina barkeri fusaro
MTKFSLLDHESVPKHEIMPEGELKSVLSKYSIEKEQLPKIKVHDPVCKEIGAVVGDVVKITRISQTAGEAEYYRLVIE

SEQ ID NO: 9957 - protein, 83 aa, Methanospirillum hungatei JF-1
MSAELNVLKHEMVPEHSIMSEEDVKNLYARYQIGPEQLPKIYHDDPAVLSIGARISDVIKIVRKSMTAGRAESYRLVVRRPKK

SEQ ID NO: 9958 - protein, 78 aa, Methanococcoides burtonii DSM 6242
MSKFSLLDHELIPHHEIMDEDDLKTVLTHYNVEREQLPKLKVTDPIALEIGAEPGDVVKVIRKSQTAGEALYYRYVIG

SEQ ID NO: 9959 - protein, 78 aa, Methanosaeta thermophila PT
MKRFAVQDHELVPEHILLTPEEAQQVLMQYGVEARHLPKIHVTDPVAKEIGAKVGDIIKIKRKSPTAKESIFYRLVID

SEQ ID NO: 9960 - protein, 80 aa, Thermofilum pendens Hrk 5
MPRKFDVLEHELVPKHVLLSKEEANRLLKAMGLKKSELPWIYSTDPVARALKAKPGDVIMIIRQSPTAGESVAFRLVMRG

SEQ ID NO: 9961 - protein, 75 aa, Pyrobaculum islandicum DSM 4184
MSKASLGVKEVVKIPKEEAKELLKQLRLKPWQLPWIRSSDPLAQSIGAKPGDVLKIVRESPTAGEFVVYRLVVPG

SEQ ID NO: 9962 - protein, 82 aa, Methanocorpusculum labreanum Z
MTRLNVLLHEMVPDHQIMTDEDVKNLLTTFDITEDHLPKIYHDDPAVKACGAKPGNVIMIVRKSQTAGEATSYRLVVRRPKK

SEQ ID NO: 9963 - protein, 83 aa, Methanoculleus marisnigri JR1
MGTSLDVLNHEMVPDHQIMGEEEVADLLATYHITLEQLPKIYHDDPAVKAIGGEVGNVIRIVRDSRTAGRAEAYRLVVKRPKK

SEQ ID NO: 9964 - protein, 75 aa, Pyrobaculum calidifontis JCM 11548
MSKQTLGVRDVILIPKEEAKALMRQLRLRPWQLPWIRASDPLAKSVGAKPGDVLKIVRDSPTAGEAVVYRLVVPG

SEQ ID NO: 9965 - protein, 78 aa, Methanococcus maripaludis C5
MKVSSHEMVPTHEIIPREEIPLLLEKYDIKLQQLPKLLDTDPLVLEVEATPGDVLKITRMSPTAGETTYYRLVIATSP

SEQ ID NO: 9966 - protein, 75 aa, Pyrobaculum arsenaticum DSM 13514
MSRVSLGVREVSVIPKEEAKELLKRLRIRPWQLPWIRSSDPLAKLVDAKPGDVLKIVRESPTAGEFVVYRLVVPG

SEQ ID NO: 9967 - protein, 83 aa, Metallosphaera sedula DSM 5348
MRSSSKKIDPSVHVLVPKHEVLSVEEAFKVLKELGIGPEQLPWMRASDPMARTINAKPGDIVKITRKSPIVGELVVYRYVVSG

SEQ ID NO: 9968 - protein, 78 aa, Methanococcus vannielii SB
MKVSSHEMVPEHEIIPGDEIPFLLEKYGIKIQQFPKLLISDPLVIEVGAKVGDIVKITRKSQTAGETVYFRLVVSNSV

SEQ ID NO: 9969 - protein, 78 aa, Methanococcus aeolicus Nankai-3 [sequence omitted]

SEQ ID NO: 9970 - protein, 78 aa, Methanococcus maripaludis C7
MKVSSHAMVPTHEIIPREEIPLLLEKYNIKLQQLPKLLDTDPLVLEVEAAPGDVLKITRMSPTAGESTYYRLVIATSL

SEQ ID NO: 9971 - protein, 83 aa, Candidatus Methanoregula boonei 6A8
MSTKLNVLSHVMVPDHQLMSEEEVSALLSRYHITTEQLPKIYHDDPAVKAIDAKVDDVIRIIRKSHTAGRAEAYRLVIRRPKK

SEQ ID NO: 9972 - protein, 78 aa, Methanococcus maripaludis C6
MKVSSHEMVPTHEIIPREEIPLLLEKYNIKLQQLPKLLDTDPLVLETEATPGDVLKITRMSPTAGESTYYRLVIATSL

SEQ ID NO: 9973 - protein, 83 aa, Nitrosopumilus maritimus SCM1
MATKKNQILVPDHIYVPKHEIISKTEAEEVLKKYNCKPTELPLIFVNDPAILGLGVKPGDMIKITRKSPTAGEGLYYRYVVEV

SEQ ID NO: 9974 - protein, 75 aa, Thermoproteus neutrophilus V24Sta
MGGVSLGVKNAVVLSKEEARELLRRLRLRPWQLPWIRSSDPLVQSIGAKPGDVIKIVRESPTAGESVIYRLVVPG

SEQ ID NO: 9975 - protein, 75 aa, Halorubrum lacusprofundi ATCC 49239
MVDVSQHELVPDHVLLEAEEVDEVLAEYDVKRTNLPKIKRTDPALPDEAEVGDVVKIVRNSRTTEEAVVYRLVVS

SEQ ID NO: 9976 - protein, 75 aa, Halorhabdus utahensis DSM 12940
MVDVSQHELVPEHTILDDGELEEVLGEYDIKRTDLPKIKRADPALPDEAEVGDVIKIARDSRTTDTAVVYRLVVE

SEQ ID NO: 9977 - protein, 83 aa, Candidatus Methanosphaerula palustris E1 9c
MSTKINVLDHLMVPDHQIMSEEEVKALLSRYKITYDQLPRVYHDDPAVKQIGGKVGEVVKIVRISQTAGTAESYRLIIRRPKK

SEQ ID NO: 9978 - protein, 75 aa, Halomicrobium mukohataei DSM 12286
MVDVSQHELVPDHSIVDEDVLDDVLEEYNIKKTDLPKIKRTDPATPDEAEVGDVIKIVRNSRTTDQAVVYRLVVS

SEQ ID NO: 9979 - protein, 186 aa, Dechloromonas aromatica RCB
MRTTNTLATLGWAAWIALAAPLAWAGDGHDHGEAPASSAGPAAPRFAATSETFELVGVVNGKQLTLYLDRYADGSPVKDAKLELELGGVKVPVEPHAEGEFEATLAQELKPGVVSVAATVIAGEETDLLAGELDVHEEAHAETTAHTHGWKEYALWAGIAGGTLFVLATLLRRLRASRKPHFGGAA

SEQ ID NO: 9980 - protein, 186 aa, Acidovorax sp. JS42
MKSSHSLAALCLASVLLGNALPVIAGDGHDHGDTAPAATGTALPRFAAVSETFELVGVLDGKQVTLYLDRFVDNTPVRGAQIELEIDGTKFKAEAHGDDAYEVVLKEAPKPGVLPITATVTAGAEVDLLAGELDLHEAAHTDEPAHELSWKEVGGWASGGLAVLAVLVFGGRRLMAARQVRAGGAA

SEQ ID NO: 9981 - protein, 186 aa, Polaromonas naphthalenivorans CJ2
MIIWKKLNVCFLATFIAATSFTALADAGHDDGAAPIAATGSAQPRFTAVSETFELVGVLNGKLLTLYLDRADDNSPVKDAKLEIELADIKLDVKPRGVGEFETTLAQELKPGVTAIAATVIAGQETDLLAGELDIREGAHADASARSLPWKKYGIWTVAGLLALALLVGGLRRFRTNRINRAGSTA

SEQ ID NO: 9982 - protein, 184 aa, Methylibium petroleiphilum PM1
MNLPHTLAALFVAATFLGSPAWAGEGHDHGDAAPAAVGQALPRFSAVSETFELVGVLSGKQITLYLDRFGDNSPVRGAQIELEIGGAKFKAEKQGEDEYEVVLPEAPKEGVLPITATVTAGTEVDLLAGELDIHIEAHADEAVHTHSWTEYAAWGAGGLAALALLAWGGRRAMSARSVRAGGAA

SEQ ID NO: 9983 - protein, 185 aa, Methylibium petroleiphilum PM1
MTSTSLWAALAVAALLATGEAAHAGEGHDHGSEAPAPAGVALPRFAAVSETFELVGVLNGRQLTLYLDRTADNRPVRDAEIALEIGGQPVKAEAHGDAEYEVVLAEAPAPGVLPITATVTAGDELDLLAGELDLHAPVHAEAANPAHATKAYAAWFVGAIAVLALLGWGARRVLGGRRVRTGAAA

SEQ ID NO: 9984 - protein, 194 aa, Delftia acidovorans SPH-1
MNFKKHCMGYVAAALFAFADVSLAAPGAHGPNGEHLDGPATQVQGSSAPRLETRSESFEMVGRLSVSEFSMFINRYETNEPVLNAQVELELGNLKATAPFHADQGDYAVADEAFLKALAAPGEHAMVIMVTAGNEADLLDGTLVVLSESAEHGHGHHMSNAIKAAIVAGLALLFLIGWAVMRRKATAKKAGVSQ

SEQ ID NO: 9985 - protein, 207 aa, Leptothrix cholodnii SP 6
MKPSLSFVRQGLLALALAISFPPLHAGPGAHGPNGEHLDSPAPATARSSTSPRFETRTEAFEMVGRLEGGELTLFINRFETNEPVLDAQVELESGALKVKAPFLADHGTYSVADAAFLKALAEPGQHPLVITVVAGNDADLLEATLTGAGATAVAVADRGHDDPHGQAATPWRSVTIGLGAVAAVAAIGWFAIRRRSAGKTSMGASL

SEQ ID NO: 9986 - protein, 187 aa, Thauera sp. MZ1T
MKASLTLAAWSLAAVLAGVTPQALAGEGHDHGDAPAPVAGPALPRFTAVSELFELVGVVDGKHITLYLDRFTDNSPVKDATLELQLDGNAIPLETHADGEFEATLQDALKPGVVSVTATVVAGQDADLLAGELDLHEQAAEVHDESAGPSLQSYAGWLGAGVLVIGLVGWAALRKGNARNRSAGGVA

SEQ ID NO: 9987 - protein, 183 aa, Diaphorobacter TPSY uid29975
MSQSSFWRAAALSSLLLGSSATWAGDGHDHGEAAPAPAAAALPRFAAVSDDFELVGVLNGQRLTLYLDHAADNRPVTDGELTLELGGQQVKVSSHGVGEFEADLTEPLSDGETSIMATITAQGQSDLLTGVLDVHSEDAEHEHAVASGRVVVLGGGAAVLGVGVLAWALRRRTRTNGALRGAA

SEQ ID NO: 9988 - protein, 180 aa, Azotobacter vinelandii DJ
MNLFPRPTACAMAVLLFAAAPGVPADDGHDHGEAPATRTGPALPRFAAVSEHFELVGVLDDGHLALYLDRADDNSPVTGATLELSVGGIAIAVEEHAPGEFEGSLAAELEEGELAVVATVAVGQVRERLTGELDIHHDEHADEHDHGISQGLYGAAAGAALLLVLLGWAVRRARTASRLV

SEQ ID NO: 9989 - protein, 154 aa, Thermobifida fusca YX
MACSACRRAEPFPPTRCSTTNSKLTSMKTRLGDLERAVMDVLWEQTEPMTVREVGRALADRDLAHTTVMTVLDRLAKKGVVRRHRDGRAWRYRPAASRETYISELMLDALGQTGDRDAALAAFVRSMSGQEAEVLRRLLLENHGEHGESDRSRM

SEQ ID NO: 9990 - protein, 185 aa, Frankia CcI3
MARLGDLERSVMDVLWASDDWLTAREVAGRLQHERDLAYTTVLTVLERLERKGFVRRQRSARAHRYAASDSREAVVAEAMMEALGTADDRGSALVRFVGSVSAEEAEILRRALEPVGSGAPGIFVPGAEAPRAEDPQAEDPHTEVRHAEARRGPAIGDPPRDDPEQIVTVATDPDRTAQIPPDHR

SEQ ID NO: 9991 - protein, 138 aa, Mycobacterium MCS
MAKLTRLGELEREVMDHLWSAREPQTVRQVHEALAARRDLAYTTIMTVLQRLAKKNLVVQHRDDRAHRYAPTHGRDELVAGLMVDALDQAADSGSREAALVHFVERVGADEAAALRRALAELEGKQGLTKPAGGPGTA

SEQ ID NO: 9992 - protein, 128 aa, Arthrobacter FB24
MASLGELERAVMDLLWAGQEAATANTLRDLLAQSTQAQGGTAGHEGKDLAVTTVLTVLSRLEKKGLVERERGTRPHRYQAVSSRADHTAELMHEVLGSAPDREAVLARFIGSVTESEAETLRKLLGHI

SEQ ID NO: 9993 - protein, 138 aa, Mycobacterium KMS; identical to SEQ ID NO: 9991

SEQ ID NO: 9994 - protein, 138 aa, Mycobacterium vanbaalenii PYR-1
MAKLTRLGELERSVMDHLWSAGEPQTVRQVHEALAAHRDLAYTTIMTVLQRLAKKNLVVQHRDDRAHRYAPTHGRDELVAGLMVDALDQAADSGSREAALVHFVERVGADEAAALRRALAELEDKHRTGGPAGDPGTA

SEQ ID NO: 9995 - protein, 138 aa, Mycobacterium JLS; identical to SEQ ID NO: 9991

SEQ ID NO: 9996 - protein, 138 aa, Mycobacterium gilvum PYR-GCK
MAKLTRLGELERSVMDHLWSSGEPQTVRQVHEALSARRDLAYTTIMTVLQRLAKKNLVVQHRDDRAHRYAPTHGRDELVAGLMVDALDQAADSGSREAALVHFVERVGAGEAAALRRALAELEDKHPTDRPAGDSPTA

SEQ ID NO: 9997 - protein, 144 aa, Salinispora tropica CNB-440
MTRLGELERAVMDVLWDLFPGRSDGLMVREVVDALAGRELAYTTVLTVLDRLSGKGMVLREREGRAWRYRAAASREAHIAQLMLDALDLGGSRDAALVRFARSVTGTEAEVLRAALNAAGEPSAPASPATPATPVTPAAKAPER

SEQ ID NO: 9998 - protein, 138 aa, Mycobacterium tuberculosis F11
MAKLTRLGDLERAVMDHLWSRTEPQTVRQVHEALSARRDLAYTTVMTVLQRLAKKNLVLQIRDDRAHRYAPVHGRDELVAGLMVDALAQAEDSGSRQAALVHFVERVGADEADALRRALAELEAGHGNRPPAGAATET

SEQ ID NO: 9999 - protein, 182 aa, Frankia EAN1pec
MARLGDLERSVMDVLWSADDWLTARDVAARLHHERDLAYTTVLTVLERLERKGFVRRQRAARAHRYAATDSRETVVAEAMLEALGTADDRGSALVRFVGSVSAEEAEILRRALEPAVPAEASDPGDPSASADSADSAKTTVGGPEDVTDVTDGAVTTTPASTSGESRIATEARPVQLPADER

SEQ ID NO: 10000 - protein, 159 aa, Salinispora arenicola CNS-205
MTRLGDLERAVMDVLWDTPSGTSEGVTVREVVDALAGRELAYTTVLTVLDRLAGKSMVRREREGRAWRYRAAASREAHIAQLMLDALDLGGSRDAALVRFARSVTGTEAEVLRAALSATSESVPPAGPTRPTETTPEAAQPDVTDRATWARLAGGATDR

SEQ ID NO: 10001 - protein, 127 aa, Arthrobacter chlorophenolicus A6
MASLGELERAVMDLLWAGQEAATANTLRDQLARTSAAQGGPGHEGKELAVTTVLTVLSRLEKKGLVERERGTRPHRYQAVSSRADHTAELMHEVLGSAPDREAVLARFIGSVSEGEAETLRKLLGHV

SEQ ID NO: 10002 - protein, 131 aa, Kytococcus sedentarius DSM 20547
MPNTASGLGDLEQAIMNHLWDTPAPQADGFTVRDVHETLGADRDIAYTTVMTVMDRLSRKEFLTRTKQGRAYVYRAATSREDFVARLMRETLGDLRPTDRRAAVLAFVDDAGADDVAALREALDRLESPTR

SEQ ID NO: 10003 - protein, 129 aa, Catenulispora acidiphila DSM 44928
MANERAGGPPRLGELERAVMDVLWNAPDGSTAQEIVERLAARDGTAELAATTVLTVLDRLRRKDFVERERVGRAHRYRAARTRDDVIAASMLAVLETTDDRRSALVRFAGSVSAEEAALLREALAGLEE

SEQ ID NO: 10004 - protein, 127 aa, Saccharomonospora viridis DSM 43017
MDVARLGELERAVMEVLWARDEPVSVRAVHAALGDRGLAYTTVMTVLTRLAGKGLVRRSREGRAWLYRPAAAREAYVAELMLEALELSGDRGSALVHFAKSVTSDEADALRQALQQGHQPEQQGKQT

SEQ ID NO: 10005 - protein, 116 aa, Nakamurella multipartita DSM 44233
MAGRGELERAVVDVLWDAGEPMTARAVVEALPGRELAVTTVLTVLSRLETKGLVRRSRDGRAHSYEATAGREEHLATLMRQVLDGAPDRDAALTRFVGGISEQDQEALRRALDGPC

SEQ ID NO: 10006 - protein, 121 aa, Synechococcus sp. CC9605
MSPRKTYILKLYVAGNTPNSMRALKTLRNILETEFRGVYALKVIDVLKNPQLAEEDKILATPTLSKILPPPVRRIIGDLSDRERVLIGLDLLYDELSDTSLNSSLIDAVDEETDTTISSDP

SEQ ID NO: 10007 - protein, 102 aa, Rhodospirillum rubrum ATCC 11170
MGPTVHLTLYICGETLRSRNALRAIDRIRHAYGPHCAIKVVDVIDSPAEAEEQRILATPTLVRDLPPPRRRVVGDLIDVDQVCRILDLPLPPSCLENADITP

SEQ ID NO: 10008 - protein, 108 aa, Prochlorococcus marinus MIT 9515
MAARKTYILKLYVAGNTPNSMRALNTLKEILENEFKGVYALKVIDVLKQPQLAEEDKILATPTLAKILPPPVRRIIGDLSDREKVLIGLDLLFDELSESELNGGKKNK

SEQ ID NO: 10009 - protein, 105 aa, Prochlorococcus marinus MIT 9301
MAARKTYILKLYVAGNTPNSMRALNTLREILENEFKGVYALKVIDVLKQPQLAEEDKILATPTLAKILPPPVRKIIGDLSDREKVLIGLDLLFDELTETEYSGNK

SEQ ID NO: 10010 - protein, 101 aa, Roseiflexus sp. RS-1
MTSKFVLKLYVTGQTPRTERAIQNLRRICEQNLGSQYQLFVIDVLEQPHLAEQERILATPTLIKELPPPVRRIIGDLSDTLKVLQGLDLPVHPSSTGGTQE

SEQ ID NO: 10011 - protein, 133 aa, Candidatus Methanoregula boonei 6A8
MKKLSGTGKSAPNHTVKQGEMLPTTPDINRKETETEIDETADGRWILRLYVAGQTQNSLTAFENLKKICEDYLGGKYTIEVIDLIKDPQLAKDHQIIAVPTLIRKLPVPVKKIIGNLSNTEKVLVGLDLRKVR

SEQ ID NO: 10012 - protein, 101 aa, Roseiflexus castenholzii DSM 13941
MTSKFVLKLYVTGQTPRTERAIQNLRRICEQNLGSQYQLFVIDVLEQPHLAEQERILATPTLIKELPPPVRRIIGDLSDTLKVLQGLDLPVHPMGTGGTQE

SEQ ID NO: 10013 - protein, 193 aa, Shewanella sp. ANA-3
MSTMLIAVILLTLLALFFGVLLGFAALKFKVEGNPIVDELEAILPQTQCGQCGYPGCRPYAEAIANGDKVNKCPPGGTATMEKLANLMGVEPEPLNAEAQSQVKKVAYIREDECIGCTKCIQACPVDAIIGAGKLMHTVLTADCTGCDLCVEPCPVDCIDMIPVGQNLKNWNWRLNAIPVTLIQETPHEEKRG

SEQ ID NO: 10014 - protein, 220 aa, Verminephrobacter eiseniae EF01-2
MSQPPAADALADLAARIDAALPQTQCTRCGYPDCRAYAQAIAEGAAAINQCPPGGAEGVARLAAITGQTALALNARHGSEGPRSVAFIDEDWCIGCTLCLKVCPTDAIVGASKMMHTIIERYCTGCELCLPVCPVDCIALDTASGATTGWAAWSAAQAQQARQRYRRHRQRMPGEDPLAQRSAAAGSATEQADQAADQARQARIAAALERARQRRQAGPH

SEQ ID NO: 10015 - protein, 204 aa, Shewanella baltica OS185
MSGILIAVILLTLLALVFGVLLGFAALKFKVEGNPIVDELEAILPQTQCGQCGYPGCRPYAEAIANGDKVNKCPPGGTATMEKLATLMGVEPEPLNAEAQSQVKKVAYIREDECIGCTKCIQACPVDAIIGAGKLMHTVLTTDCTGCDLCVEPCPVDCIDMIPVTPNLKNWNWRLNAIPVTLIQENSIQETNIQETKSEEEKRC

SEQ ID NO: 10016 - protein, 197 aa, Vibrio harveyi ATCC BAA-1116
MSTILIAIIALAALAAVFGAILGFASIRFKVEADPIVDQIDSILPQTQCGQCGYPGCRPYAEAIANGDQINKCPPGGQATIEKLADLMGVEAEESAHDLDSKVKTVAFIHEDMCIGCTKCIQACPVDAIVGGTKALHTVIKDECTGCDLCVAPCPTDCIEMIPVETTTESWKWKLNAIPVVNITDAANAANVTDSIK

SEQ ID NO: 10017 - protein, 204 aa, Shewanella baltica OS195; identical to SEQ ID NO: 10015

SEQ ID NO: 10018 - protein, 192 aa, Salmonella enterica serovar Heidelberg SL476
MNTIWIAVGALTLLGLVFGAILGYASRRFAVEDDPVVEKIDAILPQSQCGQCGYPGCRPYAEAVGLQGEKINRCAPGGEAVMLKIAELLNVEPQPCDGEEQQAAPVRMLAVIDENNCIGCTKCIQACPVDAIVGATRAMHTVMSDLCTGCNLCVDPCPTHCIELRPVNETPDSWKWDLNTIPVRIIPVEQHA

SEQ ID NO: 10019 - protein, 192 aa, Salmonella enterica serovar Schwarzengrund CVM19633
MNTIWIAVGALTLLGLVFGAILGYASRRFAVEDDPVVEKIDAILPQSQCGQCGYPGCRPYAEAVGLQGEKINRCAPGGEAVMLKMAELLNVEPQPCDGEEQQAAPVRMLAVIDENNCIGCTKCIQACPVDAIVGATRAMHTVMSDLCTGCNLCVDPCPTHCIELRPVNETPDSWKWDLNTIPVRIIPVEQHA

SEQ ID NO: 10020 - protein, 192 aa, Salmonella enterica serovar Dublin CT 02021853; identical to SEQ ID NO: 10018

SEQ ID NO: 10021 - protein, 111 aa, Shewanella oneidensis
MNGNNSINMNIDNAAKVLKELGHPTRLALFRILVKGGYEGVAVGQLQEELQVPGSTLSHHISALVSAGIISQRREGRVLYCVPDYQLLQGLVHFLQDQCCSAQRPKIEIEP

SEQ ID NO: 10022 - protein, 96 aa, Colwellia psychrerythraea 34H
MDIDVIAKALKELGHPTRLAIFKRLVKSGEQGIAVGEVQEELQIPGSTLSHHISSLASAGLITQRREGRVLYCVVEYDKLLSVIAFLQDECCIDEQ

SEQ ID NO: 10023 - protein, 111 aa, Jannaschia CCS1
MKQTAPPLPELTLAATAFAALGSEQRLAIVRRLVRAGPDGLTMGDLGADVGVAGSVLTHHLKQLVSAGLVSQRKDGRRILSRIDHPAIEALSAFLIAECCADAGGHGDHHG

SEQ ID NO: 10024 - protein, 107 aa, Ruegeria sp. TM1040
MDEAVAAQGFAAMGSEARLEVLRVLVRAGETGVSVGDIRERTGIAASTLAHHLKFLAAAGVVSQEKVGRSTICRADLAHLERLAGYILSECCLDEKLGQVARVANDG

SEQ ID NO: 10025 - protein, 97 aa, Shewanella frigidimarina NCIMB 400
MSIEIVAKALKELGHPTRLAVYKQVMKAGPKGVAVGKLGDNIGIPNSTLSHHISSMITAGLITQHREGRVLYCIANYEMRENVLNFLQQECCIDSTF

SEQ ID NO: 10026 - protein, 95 aa, Shewanella sp. ANA-3
MNTENAAKVLKELGHPTRLALFRILVKGGYGGVAVGQLQEALQIPGSTLSHHISALMSAGIISQRREGRVLYCVPDYELLQGLVHFLQDQCCSEQ

SEQ ID NO: 10027 - protein, 95 aa, Shewanella putrefaciens CN-32; identical to SEQ ID NO: 10026

SEQ ID NO: 10028 - protein, 97 aa, Vibrio harveyi ATCC BAA-1116
MELEAVAKALKELGHPTRLCIYKEVVKAGYEGIAVGGVQDKLGIPASTLSHHISSLASAGLISQRREGRTLYCVAEYECLDTVIGFLRDECCINENC

SEQ ID NO: 10029 - protein, 98 aa, Escherichia coli E24377A
MQLEEVAKALKELGHPTRLFIFKHLVKAGEQGLPVGELQKQLGIPGSTLSHHISALVSVGLVKQNRESRTLMCVSQYAMLEAIIEFLREECCVNSKIA

SEQ ID NO: 10030 - protein, 114 aa, Dinoroseobacter shibae DFL 12
METKTDSRAQAAAAFAALGAPQRLGVLEVLVRAGPEGLPIGVLGARAGVSGSTLTHHVKTLVQAGLVQQTREGRIIRCTVVYDRVTGLSDYLLAQCCADTPTGHDHGRDLHTAS

SEQ ID NO: 10031 - protein, 103 aa, Shewanella woodyi ATCC 51908
MTGARMDLEFAAKAMKELGHPTRLAIFKRLVKSGYQGIPVGEVQEELSIPGSTLSHHISSLISAGLVKQHREGRVLFCVPQYEVLQEVIDFLQAECCSAQKCG

SEQ ID NO: 10032 - protein, 107 aa, Escherichia coli SMS 3 5
MQLEEVAKALKELGHPTRLFIFKHLVKAGEQGLPVGELQKQLGIPSSTLSHHISALVSVGLVTQNRESRTLMCVSQYEILEAIIEFLREECCVNSKTDVAEPAGKNG

SEQ ID NO: 10033 - protein, 106 aa, Escherichia coli SMS 3 5
MQLEEVAKALKELGHPTRLFIFKHLVKAGEQGLPVGELQKQLGIPGSTLSHHISALVSVGLVKQNRESRTLMCVSQYAMLEAIIEFLREECCVNSKTDGEGATKNK

SEQ ID NO: 10034 - protein, 154 aa, Brucella suis 1330
MAHPQVGDMAPDFTLPSDHGEITLSSLKGHPVVVYFYPKDDTSGCTREAIAFSQLKAEFDRIGVRVIGLSPDSATKHARFRTKHALTVDLVADEDRVALEAYGVWVEKSMYGRKYMGVERTTFLIGADGRIAQVWNKVKVDGHAQAVLEAARRL

SEQ ID NO: 10035 - protein, 209 aa, Nitrobacter winogradskyi Nb-255
MSKKIRKKSSKSDSSVTVRAATVAHTEQAREAGPSPSPAATTKTKPRPAPPASQGAGLAEGSPAPPFNLPREDGALVSLADFAGGKLVIFFYPRAGTPGCTIEAMDFTRLATDFAVSGTAVIGVSADPVKAQLSFRNKHQLSIALISDEKHQMLEAYGVWGEKSMYGKTFMGVLRTTVLVDGAGRIARIWRRVKVEGHADEVLAAAREL

SEQ ID NO: 10036 - protein, 222 aa, Rhodopseudomonas palustris HaA2
MSKQTRKNPSKSESLKTPAAKSAAAAGMAAKSSPTKKSSPTKTTKAKAKPASPAKAKTPAAKPAAPAVAGLAEGAQAPAFTLTRDGGETVTLASFSGKKLVLFFYPRANTPGCTKEAIDFTRLKPAFETCGAAVVGVSADSVKAQDSFRDKHGLATPLLSDPTHAMLEAYGAWGEKSLYGRKFEGIVRSTVLIGRDGKIARVWRNVKVDGHADQVLAAAQLL

SEQ ID NO: 10037 - protein, 153 aa, Jannaschia CCS1
MPEVGQPAPDFTLPRNGGGTLTLSAQRPKPVVLYFYPKDDTPGCTKQAITFTEMAPQFEAAGAEIIGISKDSVAKHDKFINKHALNITLVSDEDGDTCEQYGTWVEKNMYGKKHMGIERATFLIDAEGSIVQVWRKVKVPGHVEAVLDAVQAL

SEQ ID NO: 10038 - protein, 178 aa, Rhodopseudomonas palustris BisB18
MEAAGAKPVVAAPVVEAPPRSSKGVLAEGHAAPAFELPRDGGGMVSSHSFAGRKLVVFFYPRASTPGCTKEAIDFTRLADAFATAGIGVLGISADNLKAQDAFRDKYQLTTPLLSDETHQILEAYGVWGEKSMYGKIFQGILRTTVLIGKDGRVGKIWRNVKVDGHADEVLAAAIELE

SEQ ID NO: 10039 - protein, 220 aa, Rhodopseudomonas palustris BisB5
MSKQSRDKSPKSATAKKPAAKSPAPAKKSAATSASKTAVAKAKPAATAKAKAPGKATAAKPAAPTAAGLAEGAKAPAFTLPRDGGESVTLSSFSGRKLVIFFYPRANTPGCTKEAIDFTRLKQAFEACGTAVVGVSADSVKAQDSFRDKHDLATPLLSDPTHEMLEAYGAWGEKSLYGRKFEGIIRSTVLIGGDGKVARVWRNVKVDGHADQVLAAAQLL

SEQ ID NO: 10040 - protein, 211 aa, Nitrobacter hamburgensis X14
MSKKIRKNSSKPDAPEAARTATAGRAKSARNADPSSSLAASEKSKSGSAKSRPESQGTDLAEGSRAPSFNLPREDGTRVSLADFAGRRLVIFFYPRAGTPGCTREAMDFTRLAKEFAACGTTVLGVSADPVKTQDSFRTKHKLSIPLISDEKHDMLEAYGAWGEKSMYGRVFLGILRSTVLVNADGRIARIWRRVKVDGHAEEVLAAARDL

SEQ ID NO: 10041 - protein, 153 aa, Ruegeria sp. TM1040
MLEPSDLAPAFTLPRDGGGEVSLSDLKGQVVVLFFYPRDDTPGCTKESIGFSEHLQAFADAGAAVYGISRDTVAKHDKFVAKHGLTVPLLSDAESTMCEDYGVWVEKNMYGRKSMGIERSTFVIDRDGKIARIWRKVKVPGHVEEVLEAVKEL

SEQ ID NO: 10042 - protein, 158 aa, Mesorhizobium BNC1
MAIVEKGDIAPDFELPQDGGRTFRLSSLRGKPVVLYFYPKDDTSGCTAQAIEFSARKDEFEALGISIVGLSPDTVKSHDKFKAKHDISISLVADPEKKVVQDYGVWVEKSMYGRKYMGVERSTFLLDAEGRIAELWRKVQLKGHVDAVLKAAKALRDS

SEQ ID NO: 10043 - protein, 153 aa, Rhodobacter sphaeroides 2 4 1
MTDAGQTAPDFTLPRDGGSTVSLSGLRPGKVVVYFYPKDDTSGCTLEAQEFTALAPQFAEIGTTVIGISKDSVKSHDKFCAKHGLGIVLASDEGATTAEDYGVWKEKNMYGKTYMGIERSTFLIDGEGRIARVWRKVTARGHAAEVLEAARSL

SEQ ID NO: 10044 - protein, 156 aa, Maricaulis maris MCS10
MSELKTGDLAPTFKLPADGGGTIDLADLRGQIVVLYLYPKDDTPGCTTQALDFTAASAAFREAGATIIGLSKDSVKRHDNFKAKHGLEVSLVSDPEAEVIEAYGSWVLKKLYGREYMGIDRSTFLIDRDGHVARIWHKVKVKGHVDEVLEAVRELG

SEQ ID NO: 10045 - protein, 153 aa, Rhodobacter sphaeroides ATCC 17029; identical to SEQ ID NO: 10043

SEQ ID NO: 10046 - protein, 153 aa, Rhodobacter sphaeroides ATCC 17025
MIDAGQPAPDFTLPRDGGSTVSLSALKPGTAVVYFYPKDDTSGCTLEAQEFTALAAQFAEIGATVIGISKDSVKSHDRFCAKHGLGIILASDEGASTAEDYGVWKEKNMYGKTYMGIERSTFLIDGEGRIARVWRKVSARGHAAEVLAAAREL

SEQ ID NO: 10047 - protein, 235 aa, Bradyrhizobium BTAi1
MSKESRKKSSNPGVRDGIAGNRAAMAAKKAVKKTAKPVTTKPAKATKTTTAKTTVAKKAAKPATKPSAKAKPASTIPAAGGIVLAEGAKAPAFKLPRDGGGTVSLADYAGQKLVLFFYPKANTPGCTKEAIDFTRLTKEFAAAGTAVLGVSADSVKAQDNFRDKHDLAVPLISDETHEMLEAYGAWGEKSLYGRKFLGIIRSTVLIGADGRVAKVWRNVKVDGHADAVLTAAREL

SEQ ID NO: 10048 - protein, 153 aa, Brucella ovis
MAHPQVGDMAPDFTLPSDHGEITLSSLKGHPVVVYFYPKDDTSGCTREAIAFSQLKAEFDRIGVRVIGLSPDSATKHARFRTKHALTVDLVADEDCVALEAYGVWVEKSSMDANIWAWSARPFLAPMDASLRSGTRSKSMDTPKPFLKPPADS

SEQ ID NO: 10049 - protein, 155 aa, Sinorhizobium medicae WSM419
MAGLRQGDVAPEFELPREGGGTISLAALRGGPVVLFFYPKDDTKGCTQEAISFSALKEEFQSAGIMIIGISPDSAKSHDRFTRKHGLTVALASDEDKAVASAYGVWVEKSMYGRKYMGVERTTFLIDRQGVISRVWEKVKVPGHADEVLAAAKAI

SEQ ID NO: 10050 - protein, 154 aa, Ochrobactrum anthropi ATCC 49188
MAHPQVGDPAPDFTLPSDNGEISLSSLKGKPVVIYFYPKDDTSGCTKEAIAFSLLKPEFDKIGVRVIGLSPDSATKHAKFRKKHDLTVDLAADEDRVALEAYGVWVEKSMYGRKYMGVERTTFLIDAEGRIAQVWNKVKVDGHAEAVLDAARAL

SEQ ID NO: 10051 - protein, 168 aa, Parvibaculum lavamentivorans DS-1
MAKATAPKSAPAAGGLPAEGKKAPAFSLPADDGTKVTLKALAGKKVVLYFYPKDDTPGCTTEGIEFSALKKKFDAAGAVVLGVSKDTVDKHCKFRDKHNLTVRLLSDEDGKTVEAYGVWGEKSLYGRKFMGINRVTFLIDEKGVVRKVWPKVKVKGHAEDVLAAAREI

SEQ ID NO: 10052 - protein, 157 aa, Xanthobacter autotrophicus Py2
MSQFPEAGAKAPAFSLARDGGGTVALKDFKGRKLVLYFYPKANTTGCTKEAIAFNGLKAAFAAADTDILGVSADAVSAQDKFKAKYDLAFPLGSDPDKAMLEAYGVWVEKSMYGRKYMGIERATLLIGRDGKVARTWPKVKVAGHAEEVLKAAQELG

SEQ ID NO: 10053 - protein, 153 aa, Dinoroseobacter shibae DFL 12
MIETGQSAPDFTLPRDGGETLTLSAQKPRNVVLYFYPRADTSGCTKQAAGFTAHLDAFAAANTVVIGVSKDPVKKLDKFRDKHGLSVALVSDEESTVCEDWGVWVEKQMYGKTYMGIERATFLIDGTGTVRNIWRKVKVPGHVEEVLEAVKAL

SEQ ID NO: 10054 - protein, 169 aa, Methylobacterium extorquens PA1
MGSGTPSIGRKEGEMPLETGNAAPLFSLPGAGGETISLESLRGHKIVLYFYPKDDTSGCTLEAQNFNAQSEAFAATGAKVVGVSPDSVKSHDKFRAKYGLTFPLASDEAKSMLEAYGVWVEKSMYGRKYMGVERTTVLIDREGQIARVWHKVKVPGHVEEVLEAVKALA

SEQ ID NO: 10055 - protein, 155 aa, Methylobacterium radiotolerans JCM 2831
MPLSEGDPAPDFDLPASGGGRVGLSALRGHKVVLYFYPKDDTSGCTLEAQDFNGLLPAFAEADAKVVGLSPDPVKSHDKFCGKYGLTFPLAADEDKTVLEAYGVWVEKSMYGRKYMGVERTTVLVDREGRVARIWPKVKVPGHAEAVLAAARALP

SEQ ID NO: 10056 - protein, 157 aa, Beijerinckia indica ATCC 9039
MSKKLEAGDTAPEFHLPDDRGGTLSLADFAGKKLVLYFYPKDDTSGCTKEAIDLNGLKGDFDKAGTNILGVSPDSVASHVKFKTKHKLDLALGSDETKAMLETYGVWVEKSMYGRKYMGVERTTFLIGPDGKIAKIWRKVKVPGHAEAVLEAARALA

SEQ ID NO: 10057 - protein, 155 aa, Methylobacterium populi BJ001
MPLEPGNAAPLFSLPGAGGETISLESLRGHKIVLYFYPKDDTSGCTLEAQNFNAQSDAFAAAGAKVIGVSPDSVKSHDKFRAKYGLTFPLASDEAKSMLETYGVWVEKSMYGRKYMGVERTTLLIDREGRIARVWNKVKVPGHVEEVLAAAQALA

SEQ ID NO: 10058 - protein, 238 aa, Rhodopseudomonas palustris TIE 1
MPKPTPKKPSKKTAKPAVEKTSKVTTKAAAKTTAAKTTAVKKAAAKSPAAKAPAAKTAATKAAAKPAAKSAAPKPSATKSSATKPAGLAEGSVAPDFKLPRDGGGEISRADFAGRKLVLFFYPKANTPGCTREAIDFTRLAADFKACGTAVLGVSADSVKAQNSFRDKHQLATPLLSDPTHAMLEAYGAWGEKSLYGRKFQGIIRTTVLIDADGRVARVWRNVKVDGHADQVLAAAQS

SEQ ID NO: 10059 - protein, 154 aa, Methylobacterium sp. 4-46
MPLKSGEPAPDFSLPATGGETISLTSLKGRKAVLYFYPKDDTSGCTLEAKSFNDLREAFAAADTAVIGVSPDPIRSHDKFREKYGLAFPLASDEEKAMLEAYGVWVEKSMYGRKYMGVERTTVLIDRDGRVAQVWPKVKVPGHAEAVLAAAKAL

SEQ ID NO: 10060 - protein, 157 aa, Rhizobium leguminosarum bv  trifolii WSM2304
MAVPGIGATAPDFNLPRDGGGRISLAEFQGRPLVLFFYPKDDTTGCTAESLAFTALASEFEAAGAAVIGMSPDSAACHDKFIRKHRLSVALASDEEKTTLQAYGVWKEKSMYGRNFMGVERTTFLIRQDGTIATIWQKVKVQGHAETVLEAVRNLAA

SEQ ID NO: 10061 - protein, 161 aa, Methylocella silvestris BL2
MTRAAGGKCEPGMAAPEFKLPGDRGEPISLQSFKGRKLVLYFYPKDDTSGCTKEAIDFNQLKPEFEKAGAAILGVSPDTVASHVKFKTKHQLGLDLASDESKAMLGAYGVWVEKSMYGRKYMGVERTTLLIDRQGVIAQIWSKVKVPGHAEAVLAAAKALP

SEQ ID NO: 10062 - protein, 155 aa, Methylobacterium chloromethanicum CM4
MPLETGNAAPLFSLPGAGGETISLESLRGHKIVLYFYPKDDTSGCTLEAQNFNAQSEAFAAAGVKVVGVSPDSVKSHDKFRAKYGLTFPLASDEAKSMLEAYGVWVEKSMYGRKYMGVERTTVLIDREGQIARVWHKVKVPGHVEEVLEAVKALA

SEQ ID NO: 10063 - protein, 154 aa, Methylobacterium nodulans ORS 2060
MPLNPGDPAPDFSLPATGGETISLTCLKGRKAVLYFYPKDNTSGCTLEAKAFNDLRDAFAAADTVVIGVSPDPMKSHDKFRDKYGLGFPLASDEEKAMLQAYGVWVEKSMYGRKYMGVERTTVLIDRDGRIAEVWPKVKVPGHAEAVLKAAKAL

SEQ ID NO: 10064 - protein, 157 aa, Agrobacterium vitis S4
MAELSIGDMAPDFTLPRDGGGTVSLSSFKGKQVVVYFYPKDDTSGCTVEATSFTSLTPEFESSGAVIIGISPDTVKSHDKFVAKHGLAVMLGSDEEKTTLEAYGVWKEKSMYGKTYMGVERSTFLIDADGRIAGVWRKVKVPGHAEAVLQAVKDKAA

SEQ ID NO: 10065 - protein, 157 aa, Rhizobium leguminosarum bv  trifolii WSM1325
MAVPGIGVSAPDFNLPRDGGGRVSLAEFHGKPLVLFFYPKDDTTGCTAESLAFTALAAEFEAAGAAVIGMSPDSAACHDKFIKKHRLSVALASDEEKTTLQAYGVWKEKSMYGRNFMGVERTTFLIRQDGTIATIWQKVKVQGHAETVLEAVRNLAA

SEQ ID NO: 10066 - protein, 79 aa, Thermobifida fusca YX
MIIVGLSIALMVVSVLMIMLVLLHKGKGGGLSDLFGGGVTSSLGGSSVVQRNLDRLTIATGLVWIVGIVALGLLILRQG

SEQ ID NO: 10067 - protein, 76 aa, Frankia CcI3
MTIGLSIALIVASILMIMLVLLHRAKGGGLSTLFGGGVSSSLGGSSVVEKNLDRLTIAVGIIWFTCIVGLGLLLKN

SEQ ID NO: 10068 - protein, 77 aa, Mycobacterium MCS
MVLALQITLIVTSLLVVLLVLLHRAKGGGLSTLFGGGVQSSLSGSTVVEKNLDRLTLFVVGIWVVSIVGVALQIKYS

SEQ ID NO: 10069 - protein, 74 aa, Rubrobacter xylanophilus DSM 9941
MVYVLAFLHLVFCIALVGLILLHSGKGGGLSASLGGGVGGPFSGTTIMEKNLTRLTLVVLGLFVLTNVALVFLG

SEQ ID NO: 10070 - protein, 85 aa, Arthrobacter FB24
MDVLHVILQILLGITSLLLTLLILLHKGRGGGLSDMFGGGMSSGLSSSGVAERNLNRFTVILGVTWGVVIIALGLLMRFSGGGDS

SEQ ID NO: 10071 - protein, 76 aa, Nocardioides JS614
MTLLFTILLMITSALMIVLVLLHKGRGGGLSDMFGGGVSSSLGGSSVAERNLDRFTVGVGIIWFACVVALGLLFAY

SEQ ID NO: 10072 - protein, 77 aa, Mycobacterium KMS; identical to SEQ ID NO: 10068

SEQ ID NO: 10073 - protein, 77 aa, Mycobacterium vanbaalenii PYR-1
MQLALQITLVVTSVLVVLLVLLHRAKGGGLSSLFGGGVQSSLSGSTVVEKNLDRLTLFVTGIWIVSIVGMALQIKYG

SEQ ID NO: 10074 - protein, 77 aa, Mycobacterium JLS; identical to SEQ ID NO: 10068

SEQ ID NO: 10075 - protein, 78 aa, Mycobacterium gilvum PYR-GCK
MQLALQITLVVTSVLVVLLVLLHRAKGGGLSSLFGGGVQSSLSGSTVVEKNLDRVTLFVTGIWIVSIIGMALSIKYGV

SEQ ID NO: 10076 - protein, 86 aa, Salinispora tropica CNB-440
MPIWFAYTLIVLLVITSFMLVLLILLHRGKGGGMSSMFGGGVSSSLAGSSVAEKNLDRYTVLVGIVWFACIVGLGLWLRLQQSSLG

SEQ ID NO: 10077 - protein, 76 aa, Frankia EAN1pec
MTVGLSIALIVASVLLVLLVLLHRAKGGGLSTLFGGGVSSSLGGSSVVEKNLDRLTVAVALLWITCIIGLGLLLKN

SEQ ID NO: 10078 - protein, 86 aa, Salinispora arenicola CNS-205
MPIWFAYTLIVLLVITSVMLVLLILLHRGKGGGMSSMFGGGVSSSLAGSSVAEKNLDRYTVLVGIVWFACIVGLGLWLRLQQASVG

SEQ ID NO: 10079 - protein, 82 aa, Bifidobacterium longum DJO10A
MTALKITLQVIVVLLSFVLTLLILMHKGKGGGLSDMFGGGLTQNAGTSGVAEKNLNRWTVIIALVWVALIIGLDMMTKFNLG

SEQ ID NO: 10080 - protein, 85 aa, Arthrobacter chlorophenolicus A6
MDVLHVILQILLGITSLLLTLLILLHKGRGGGLSDMFGGGMSSGLSSSGVAERNLNRFTIILGVTWGIVIIALGLIMRFSGAGDS

SEQ ID NO: 10081 - protein, 75 aa, Acidimicrobium ferrooxidans DSM 10331
MLTVVLVVVQVVSAIGMVVFVLLHSGKGGGLSDLMGGSSLSSAASSSVAERNLDHITIVLALAFALSSIALGLRL

SEQ ID NO: 10082 - protein, 77 aa, Actinosynnema mirum DSM 43827
MNTFLQILLIVSSLLLILLVLLHRGRGGGLSSLFGGGMQSSLSGSSVVEKNLDRLTLFVGAIWVIAIVGIGLIQKVA

SEQ ID NO: 10083 - protein, 81 aa, Beutenbergia cavernae DSM 12333
MDALRISLQVLLVLTSGILILTILMHKGKGGGLSDMFGGGLSTSVASSGVAERNLNRITIGTALIWGVVVVLLGLIQKFTV

SEQ ID NO: 10084 - protein, 99 aa, Brachybacterium faecium DSM 4810
MAYAGSVRLSPWKVSVLVDLPLLKLILQILLAVLGLLTIMLVLLHKGRGGGLSDMFGGGVSSSASASGVAERNLNWLTVSVAVAWGLSAVALGVIEKLL

SEQ ID NO: 10085 - protein, 83 aa, Micrococcus luteus NCTC 2665
MDVLTLALQILVVVLSMVIVLLILLHKGRGGGVSDMFGGGVTTSMSSSGSAQRLLTRLTVGSVVAWGVVIALLGVLPRLTLES

SEQ ID NO: 10086 - protein, 77 aa, Kytococcus sedentarius DSM 20547
MDIIRLLLDGALVITSLFLVLLILMHKGRGGGLSDMFGGGISATGGSSTVAERNLNRITVGMAVAWFATVVALGIIK

SEQ ID NO: 10087 - protein, 81 aa, Catenulispora acidiphila DSM 44928
MTLYQWIVSGILVATSLLLIMSVLLHKGKGGGLSDMFGGGVSGGLQGSSVVERNLDRISVVLSSVWISCIVALALLYKHNV

SEQ ID NO: 10088 - protein, 76 aa, Saccharomonospora viridis DSM 43017
MELFLQILLIVSSVLLIIAVLLHRGRGGGLSSLFGGGMQSSLSGSSVAEKNLDRITLGIGAVWVIAIVGLGLLVKL

SEQ ID NO: 10089 - protein, 81 aa, Jonesia denitrificans DSM 20603
MDILRISLEVLLVVTSILLILLVLTHKGKGGGMSDMFGGGVSTSIGNAGNAQTNLNRITIAFAIVWFAAIVLLGLFPKVTG

SEQ ID NO: 10090 - protein, 83 aa, Atopobium parvulum DSM 20469
MGVLNTILLVLFILSGILTVLLVLAHSGKGTGVSDMIAASMYNASAGSGIMEKNLDRLTIITTTIFLVCAIVMALTFPVGSIG

SEQ ID NO: 10091 - protein, 78 aa, Nakamurella multipartita DSM 44233
MILFLQILLVITSLTLMALILLHRGKGGGLSSLFGGTMQSSLSGSSVVEKNLDRLTLFVAAVWAISIVGVGLLLKVGA

SEQ ID NO: 10092 - protein, 153 aa, Brucella suis 1330
MSTLEANSEQNMQVFGGKNPKAILPKRPVGEALWRGFRCRCPHCDEGKLFRAFVKPVDKCMACGEDYTEQRADDLPAYLTILVVGHIVVGLFMGVEATTNLSLWAHMAIWGPMTLIMSLLLLQPIKGSVIGLQWALYMHGFGGENESEYGDAA

SEQ ID NO: 10093 - protein, 146 aa, Nitrobacter winogradskyi Nb-255
MTALPPDTASTAGKTWTPEGEKRDTWAAMRRGLFCRCPRCGQGKLFRTFLKTADNCSECGLDFTPHRADDLPAYLVIVVVGHIVVPLALLIEKAFAPPLILQWAIYLPLTLIMALWLIQPIKGAVVGLQWALRMHGFDENFVDDQV

SEQ ID NO: 10094 - protein, 143 aa, Rhodopseudomonas palustris HaA2
MKTVVNRAPIVWPSDNAPAEDRNVWQAMWRGFRGRCPQCGEGKLFRGFLKTADNCSHCGQDFTGHRADDLPAYLVIVIVGHIVVPIALSIETNFSPPVMLQLAIYLPITLFASLALLQPVKGAVVGLQWAFRMHGFDENNPEK

SEQ ID NO: 10095 - protein, 149 aa, Rhodopseudomonas palustris BisB18
MSVDDSAARPARSWSAEVIAPEKRNAVTAIKRGLFGRCPRCGEGKLFRAFLKVDDHCAKCQLDFTPHRADDLPAYLVIVIVGHLVVPIVLWIETNYSPAVPLQLAIYLPITLLLSLGLLQPVKGAVVGLQWAFRMHGFDDNPPGDIPAV

SEQ ID NO: 10096 - protein, 143 aa, Rhodopseudomonas palustris BisB5
MKTVVNRAPIVWPSDNAPTEERNVWQAMWRGFRGRCPHCGEGKLFRAFLKTADACGHCGQDFSGHRADDLPAYLVIVIVGHIVVPIALSIETNFAPPVALQLAIYLPITLLASLALLQPVKGAVVGLQWAFRMHGFDENNPEK

SEQ ID NO: 10097 - protein, 146 aa, Nitrobacter hamburgensis X14
MTAPPPNTASTAATIWTPEGEKRHLWAAMKRGFFGRCPKCGKGKLFRAFLKTADNCSECGLDFSPHRADDLPAYLVIVVVGHIVIPLALLIEKGFSPPLVVQWAIYLPTTLVLALWLIQPIKGGVVGLQWALRMHGFDENFVEDQI

SEQ ID NO: 10098 - protein, 145 aa, Mesorhizobium BNC1
MMEEQVFGGGAHAKQHDRSVVRAMWRGFQGKCPHCGKGRLFRSFLKTVDRCSECGEEMIHHRADDLPAYLVIVIVGHVVVGAFMGVEAATEWPLWLHLAIWAPITVIMSLLLLGPVKGAVVGLQWALRMHGFGEEKEILETKPEI

SEQ ID NO: 10099 - protein, 151 aa, Bradyrhizobium BTAi1
MSSTPRALPQALPQTWTRDAGAVEKRDVWTAMKRGLRGRCPRCGEGRLFRAFLKVADACDRCGQDFSGHRADDLPAYLVIVIVGHIVVPLALSIETNYAPPVALQLAIYLPVTLIASLALLQPVKGAVVGLQWAFRMHGFDDNPVEGIPPV

SEQ ID NO: 10100 - protein, 153 aa, Brucella ovis; identical to SEQ ID NO: 10092

SEQ ID NO: 10101 - protein, 151 aa, Sinorhizobium medicae WSM419
MKATATDMLQLGGAQGDERPVGRSIKRGLFGTCPACGRGRLFRSFLKSVEACDACGERMDHHRADDFPPYIVVTIVGHVVLGGYMMTDLVLPLSTWQHLAIWAPVTLASSLALMQPVKGAVIGLQWALRMHGFGGHDDGPEDILPPRETSA

SEQ ID NO: 10102 - protein, 153 aa, Ochrobactrum anthropi ATCC 49188
MSTLEANSAQNVQVFGGESPKAAHPKRPLGEAMWRGFRGRCPHCGEGKLFRSFVKPVAQCSVCGEDYTEQRADDLPAYLTILIVGHVVVGAFMGVEATTNLPLWAHMAIWGPLTVIMSLLLLQPMKGATIGLQWALYMHGFGGKGEGEYGDVT

SEQ ID NO: 10103 - protein, 141 aa, Parvibaculum lavamentivorans DS-1
MSIPMDMSEPHIYETAEISPRPAFPAILRGFGGHCPACGTGSLFRRFLKVTDSCAHCGEELHHHEADDAPPYFTIMIVGHIVVPLMLWVELAYLPPLWIHALVWPALTLVLSLWLLPRVKGSVVGWQWALRMHGFDGVTRD

SEQ ID NO: 10104 - protein, 181 aa, Xanthobacter autotrophicus Py2
MDTPATMTVTTTLAGSEPGEARDRAPQEPPARPNGPPPARTRAVPEALLRGARGRCPACGRGRLFSSYLKVSPYCPDCGEELYHHRADDAPPYATILLVGHIVVPLMVLVEEIYRPEVWVHLILWLPLTLALCLILLPPLKGMLVSLQWALRMHGFDPQSPEREGPPDGVVPVVRAVRPVR

SEQ ID NO: 10105 - protein, 165 aa, Methylobacterium extorquens PA1
METYASPPAPAPQERTRLLPAMANGFLNRCPHCGEGHVFGRFLKVRPACEACGLEMEGHRADDLPPYIVIFLVGHIIGYLVLEIEMGYDVPLWISMTVWPLLTLVLALVLLQPVKGAVIGLQYTFGMHGFGKLPPARGGTGTGTGERRGGEAGSRAGDAPKLGSA

SEQ ID NO: 10106 - protein, 154 aa, Methylobacterium radiotolerans JCM 2831
MAADAIPERTRLIPAMARGFIGRCPHCGQGRIFGRFLKVRPECDVCGLELHHHRADDLPPYVVIFIVAHIVGYLILETESAYDVPLWVEMGVWPVFTLVFALVLLQPVKGSVVGLQYALGMHGFATLPRSRPAPGPEETRLAAAAAGAPDRHSS

SEQ ID NO: 10107 - protein, 145 aa, Methylobacterium populi BJ001
MPAMARGFLNRCPHCGEGHVFGRFLKVRPACEACGLEMEGHRADDLPPYLVIFLVGHIVGYLVLEIEMGYDVPLWISLTVWPLLTLVLALGLLQPVKGAVIGLQYTFGMHGFGKAPPARGGTGTGERRGGEAGRRAGDAPGLGSV

SEQ ID NO: 10108 - protein, 142 aa, Rhodopseudomonas palustris TIE 1
MTTLSREPIVWPPQSAPSQQRNVWQAMWRGFRGRCPNCGEGRIFRAFLKTADSCDRCGQDFTGHRADDLPAYLVIVIVGHIVVPIALSIETHYAPPVELQLAIYLPFTLLASLLLLQPVKGAVVGLQWAFRMHGFDETNPDD

SEQ ID NO: 10109 - protein, 170 aa, Methylobacterium sp. 4-46
MIEIDGRDAPAQPPAEVPWHLAMLRGFRNRCPHCGEGRLFGRFLKVREACEACGTELHHHRADDLPPYLVIFIVGHVVGLAILESQMRLDELPLWFELTFWPAVTLIMALALLQPVKGAVVGLQYALGMHGFSAIRRARTGTGQGGEARDGARDGGDDRERGRAPGLRGA

SEQ ID NO: 10110 - protein, 150 aa, Rhizobium leguminosarum bv  trifolii WSM2304
MSTPTEPVVRYGDRPEAERPLGRSILRGLMNRCPACGSGKLFRAFLKPVDHCAACGEAMHHQRADDLPPYIVILVLGHVVVGGYMLTDLTFVLPVWAHIAIWAPITVITALASIQPIKGGVIGLQWALRMHGFGGESDGPDDYDIPGRPD

SEQ ID NO: 10111 - protein, 165 aa, Methylobacterium chloromethanicum CM4; identical to SEQ ID NO: 10105

SEQ ID NO: 10112 - protein, 171 aa, Methylobacterium nodulans ORS 2060
MIEIDGRATPAAMPTEEVPWYLAMARGFRNRCPHCGQGRVFGRFLKVRDACESCGTELHHHRADDLPPYLVIFIVGHLIGLGILESQMRFEDIPLWFELAFWPAATLALALALLQPVKGAVVGLQYGLGMHGFAAIRRRRAETSPGGETRDGARDGRDDGQRGHAPDLRRA

SEQ ID NO: 10113 - protein, 151 aa, Agrobacterium vitis S4
MSVSQSPPVIRFGGGKDAVRPLGRSILRGLMCTCPACGSGRLFKAFLKPVDTCAACGEDLSHQRADDLPPYIVIMIVGHVLLGGYMMTDLVFVLSTWAHLAIWTPIAVIVSLLIIQPIKGGVVGLQWALRMHGFGDESEVIEDYDERYPPK

SEQ ID NO: 10114 - protein, 151 aa, Rhizobium leguminosarum bv  trifolii WSM1325
MSTPTDPAAARYGDTPEVERPLGRSIMRGLMNRCPACGNGKLFRAFLKPVDHCAACGEAMHHQRADDLPPYIVILVLGHVVVGGYMLTDLTFVLPVWVHLAIWAPITVITALASIQPIKGGVIGLQWALRMHGFGGESDGPDDYDIPGRPN

SEQ ID NO: 10115 - protein, 185 aa, Trichodesmium erythraeum IMS101
MCWGKLLQPDLVLGNSVLSLTLEILQKYQIQGLVLDVDETIVPIHHSQASPELAVWVEKIKSVASLWLVSNNLSQDRIGRIGDLLNIPYITAAGKPSRRKLKKAVDAMNLPVEKVAMVGDRLFTDVLAGNRLGMFTILVEPISSNGLEFSNYKVRSFEVWVSQILGVSLNLTTHSLIYDHKNDFM

SEQ ID NO: 10116 - protein, 173 aa, Dictyoglomus turgidum DSM 6724
MLDILKPKRFVDSIFDINFEDLYKRGYRGIIFDLDNTIVPWDGNELDPKTKDLIDHIKNIGFKVVILSNNWSHRRVKYFSKIMKLPALGSAFKPRVRSFKKAMKLMDTEPETTLVIGDRILTDIFGGNKIGMYTILVAPINKNEMWIKKWTVRKLENWLLDLWIRRGEITKGE

SEQ ID NO: 10117 - protein, 176 aa, Cyanothece PCC 7425
MTAGSPAFLLQPNLVLPGTILKLTPEILHRHELQGLILDVDDTLVPPWNAEVSLEVLEWLAEIKREVDLWLVSNNLNYRRISRIAEAMNLPYLLGAGKPSRRKIRQAALAMNLPFAQVGMVGDRLFTDVLAGNRLGLFTILVEPILDPADIARSAPLRSFEIWVSEKLGATLTAAE

SEQ ID NO: 10118 - protein, 186 aa, Eggerthella lenta DSM 2243
MAFLEPDRYFARISRIDIDRDLLALDFRNVLLDVDNTILTRDTHEVPRDVGFWLAKARDAGITFCLVSNNWHEGVYQLANRLSLPIVAKAVKPLPPAFLMALRKLGAKRSETVVIGDQLVTDVMGAHFLGMKAYLLAPLVEQDLPHTLLLRNFERVVMGERKPEGAASTSQNAVPCEDEEPDAQGV

SEQ ID NO: 10119 - protein, 196 aa, Cryptobacterium curtum DSM 15641
MKLLSPERYFSRISDIDIPHDLLDVGISHVLLDFDNTILSRATHDIPPDALRWIEQAKQAGITLCIVSNNWHASPFDVARTLDIAVVAKACKPLPFGLLVARGKVGARSNNAVVVGDQLSTDVLGAHLLGMRAWLVCPLAEEDLKHTVALRRLERSLIGSRLPEGAPACEGSSFAVDYSLHSDSLQPSGTKGGTAQ

SEQ ID NO: 10120 - protein, 165 aa, Slackia heliotrinireducens DSM 20476
MALLRPDRYFTRVSLIDPQADLLDRGIRFVLLDMDNTLLPRDTHEVPSDILAWLADLSKCGVGALILSNNWHESPFEWGRRLGLPVVAKACKPLPIAYGRALRTLGATRAETVCIGDQLMTDIWGGHFAGFASYLVDPLTTVDLKHTLVLRKLERKIIGGMPPEK

SEQ ID NO: 10121 - protein, 165 aa, Atopobium parvulum DSM 20469
MSLIKATQYVSAVEHISVESLVQRGIKLVLLDRDNTCVPRDTKVVPSEVSAWFEKAHAAGLMLCLVSNNIHFDEVQRSAHELGIEGEGFACKPLPRALNAAMKRFSVTKEQTVMVGDQIFTDIIAGNLAGVSTILVKPQSTEDLWYTNLIRHVERRILKNVTFTS

SEQ ID NO: 10122 - protein, 193 aa, Moorella thermoacetica ATCC 39073
MFYQFAKFVCYLFLRFICRWEVRGQENIPAEGPVVIVANHVSYLDPVVVGVAFPRMVRFMAKEELFHIPIFKYIIRGLQAFPVRRGESDRAALKTALQILHQGQVLGIFPEGTRSPDGRLLPFQAGAAVLALKTGAVLLPVAIKDTDRVFRGGHIKITFGRPLKITTSGRNYTSQQVQDLTSAAYQEVKKMLA

SEQ ID NO: 10123 - protein, 197 aa, Syntrophomonas wolfei Goettingen
MLYSFLRAILQVLFFLLGLKAEGLHNIAEKGPLILAANHVSYWDPIVVAIAVKRPINFMAKAELFDHHLLGFFVKRLNAFPVRRGLADRNAIKKALLFLEEGKILGIFPEGMRNLKEEDLKAQAGVAMIALKSGAPVVPVACVGTNRILPLGWFRPLKVRVGDPIGLEEYQGQKVNSAVMEKLSSEIMTKINLLLQK

SEQ ID NO: 10124 - protein, 203 aa, Clostridium thermocellum ATCC 27405
MYASLKNIYYGFLRAIITTFFDLFYRVSIIGIENVPVEGPVLLCANHIAEMDMFFIGYRLKRLVRYMAKEELFRIPLVSSFIKSLGAFPVKRGKGDVGAIKTALKLLEEGHIVGIFPEGTRLKNKKGKNIKAKPGAALLAQKSGAPILPVAISGRYRPFSKIKVVFGKPFTLDLDKNTKYTNSELVEFSESIMKKVYSLLGEY

SEQ ID NO: 10125 - protein, 194 aa, Desulfotomaculum reducens MI-1
MLYTTLRFIIRYILLIWRRWKIVGRDNLPVSGGVLVVSNHVSNLDPLVVGCALTRRIHFMAKVELFKIPILASLIRMLGAFPVNRERSDRKAIRMALEYLQNGEVVGIFPEGTRSKTGELQKAQIGAAMLAVKSNTPILPVALIGTRGIFNKVVVKIGEPLYIPELWRSRASKEQLEALSEQVMKEIERLINNQ

SEQ ID NO: 10126 - protein, 193 aa, Candidatus Desulforudis audaxviator MP104C
MFYWFCWHLCRTVLLVLRRWEVKGAENLPVSGGLILAANHSSYWDPVVCGCVMNRRIYFMAKAELFRIPVLRTIITAWGAFPVHRETVDREAIRTALAHLKAGRVVGMFPEGTRSKSGELQKPHYGAALVALKGGVPILPVALIGTKGVFGKVRVRIGKPLHFPEYAGNKPSKEVLEEMSNRVMGEIGTLLKA

SEQ ID NO: 10127 - protein, 195 aa, Natranaerobius thermophilus JW NM WN LF
MENKRTSLYIVLRFLFRLLFKVVYPIKLEGKQNLPHNGPAIICSNHISLLDPILLGCISEPHVTFMAKEELFNIPVIGRIIYLLGALPVKRGQVDRNAIKLSLKQLSKNCVFGIFPEGTRHSEDKKPLKGVGFLAARSKAHVVPVTIIGPYRLFRKTRVVVHQPVNYDELDFAKSEDPLLGFSQYIMDTINSELN

SEQ ID NO: 10128 - protein, 195 aa, Elusimicrobium minutum Pei191
MLLNLIKFTFRWFLIIFYNAKVEGLENIPKTGRLIIVSNHRSNVDPPLLGGFAGLVRDSRYVIKKQLMSLPLLGRLFKSYGFIPVDRQAGKDMGAFKAIMSSLKKEESVVIFPEGTRSKTGKPLKPKAGVSFVAHKTNSPVLICRVFNTFGFPWVRNLRVVYSHTIKFEEVEGVDLKVQYQQFADKIMSEIEKVK

SEQ ID NO: 10129 - protein, 196 aa, Desulfitobacterium hafniense DCB 2
MNLYQFLKRIFRLQFRVMGWKIHGVENLPKEGPVIIVSNHVSIWDPVVAACSVPRDVSFMAKEELFANPLLGGIFRRLGAFPVKRGQGDTSAIRNSLKVLKEEKVLGLFPEGTRSKTGAIQKGFPGMILLMEKSQAPIVPVRVNGTQNLFVRGWGHLEVIVGKPIFPEQLKAPEGVENRREWAADQIMKAIVELKA

SEQ ID NO: 10130 - protein, 193 aa, Geobacillus WCH70
MDFYSFAKGVVKSILTPLYRIEVIGAEKFPKEGGVLLCANHISNLDPPILGITAPRPIHFMAKEELFRVPLLKNLITTLHAFPVKRGMSDRQALRTGLEVLKQGHVLGIFPEGTRSKDGKLKKGLPGVGFFALRTSAAVVPCAIIGSYRPFVPLKVVYGSPIDMTPLREKKASPEEATAYIMQHIQALLDQYR

SEQ ID NO: 10131 - protein, 200 aa, Anaerococcus prevotii DSM 20548
MLYNFLVVLLKIICFPIFRIKVKGLENIEETDKVIVCANHKSLLDPIFLAISLPQRIYFMAKKELFDKPFVGGFLKALGAFPVDRFGRDLKALRASVALVNEGKILGIFPEGTRVKEVKRENVKDGVAFVALKAKADIMPVEIISTYKPFRKSEILIKKPIAVSEFASLKNKEAMKKMTDRVYDKIYEHHTIVESENQWK

SEQ ID NO: 10132 - protein, 194 aa, Desulfotomaculum acetoxidans DSM 771
MIYQTSKFLCTAVLKILRRWQIQGLGNLPAKGGFLIVSNHTSYWDPLAVGCAIKPRIYYMAKAELFKIPVFRELITSFGAFPVHREKADRQAIRMALKLLKEGKVVGIFPEGTRSHSGELLQPHLGAAMLALKSQVPVVPVAVLDSKGIFRRLKLNIGKPFYIGNRQSDQTPKEIIEAGTEQIMSEISHLMQLK

SEQ ID NO: 10133 - protein, 200 aa, Alicyclobacillus acidocaldarius DSM 446
MSGESSDLPRTLFYRFARAVVTAFFRTCFRVRVEGLERLPRQGGVILASNHLSNFDPPLLGILVPRYIRFMGKAELFRIPVLRRMFLSLGGFPIERGRVDRRAIRTAIEVLQGGTCLVMFPEGHRSRTGKLGPLQPGIASIARKAGAIIQPVGIRGRYRMFGRIEVRFGDPIDVREWSDEEIMRNLRDQLLLLTGQEESR

SEQ ID NO: 10134 - protein, 219 aa, Desulfovibrio desulfuricans G20
MAEHIIVTLDGPAGVGKTTLARNIAEELGIAYMDTGAMFRSIGWKLGNVVESVPPAEIEKKLAGFRFSLSGAGAATQLSLNGTPVGDEIRTEEVALLASAVATLPVVRTFLKKTQQKLGSEVSLVAEGRDMGTVIFPAARYKFFLDATPEERARRRYEQLTAAGETPDLKALTDQIRKRDHQDRSRVVAPLRPADDAIIIDTTELDVQGVFAAIMSKLK

SEQ ID NO: 10135 - protein, 225 aa, Syntrophobacter fumaroxidans MPOB
MNNATIIAIDGPAGAGKSTVSRLLAKELGYTYLDSGAMYRALAWALQREGVDLEAEAHVARALPELPLEFSTRGGSLLIHCGGKALEDELRNPEMAAYASRISQMRAVRTFLTEWQRKLAEAGKVVAEGRDTATVVFPHAGVKVFLTADPAARAGRRHAEYLAKGIRVDYAVLERQIRERDEADSTRCLAPLRPADGAVILDTSDLDISEVMSRLMDLIREKSRG

SEQ ID NO: 10136 - protein, 232 aa, Desulfovibrio vulgaris DP4
MPDTTGGHPAALKVVTLDGPAGVGKTTLARRVADALGIPYLDTGAMFRTMAWRLGPDGPDLDEALLRDRLAGFIFTLRGRGGASVLSCNGEDIGNEIRTEDVGAMASRIAALPVVRECLKAAQQRMGAAQPLVVEGRDMGTVVFPGARHKFFLDAAPEIRAMRRYTQLQTMGEAHDLALLTEQIRSRDEQDRNRAVAPLRPAADAIIVDTGDLDIDGVFGVIMQHIRSRDGL

SEQ ID NO: 10137 - protein, 237 aa, Anaeromyxobacter sp. Fw109-5
MTAGRPFIVAIDGPAGAGKSTVSRRVASRLGFAMVDTGAIYRTVALAATRRGIALDDDAALAVLLPELEIRFSPSPGGGQRVLLGEDDVSVEIRTPPISLGASKVSARPVVRAGLLDLQRRLACAPENRGAVLEGRDIGTVVFPDADAKFFLTASAEERARRRHAELGARGDASTYDEVLADQLRRDKDDSERAIAPLRPAADAQLVDTSGLPLDAVVDALVRELEARLSGDGRSEA

SEQ ID NO: 10138 - protein, 222 aa, Candidatus Desulfococcus oleovorans Hxd3
MKPLLITIDGPAGAGKTTVSKALARCLGYRYVDTGALYRGVALAAKEKGVAPEDDDGLERLCTGLRLRFVVNEDGSRLFDGDRDISGLIRTSEISMLASAVSARPVVRKFLFDLQRRLGEEKNAVFEGRDMGTVVFPEAEVKFFLDASVEERARRRYDERSADETRTLEQIAEEIRTRDHNDRTRSHAPLKPANDAILLDSTAISIDQVVQSMLSRIKQVDF

SEQ ID NO: 10139 - protein, 219 aa, Desulfovibrio vulgaris  Miyazaki F
MVTLDGPAGVGKTTLAKRLADALGVAYLDTGAMFRTLAWKLGPGAHELPEGDLRARLEGFCFALSGAGGASVLSCNGVPVGEEIRTEEVAALASRIATLPVVRERLKAAQQALGASCALVVEGRDMGTVVFPTARHKFFLDATPEERARRRCQQLEAQGQPADLATIAAQIRERDDMDRNRAVAPLRAADDAETVDTTTLDIDGVFAELTRHITARGGL

SEQ ID NO: 10140 - protein, 230 aa, Desulfovibrio desulfuricans ATCC 27774
MSARLPVVTLDGPAGVGKTTLARRMAESLGLAYLDTGAMFRCMALKLGPGAEKLPEEELRARCAHWTFSLGGMGQQSTLFCNGVAVRGEVRTEEVGMLAARIATVPVVRDILRQTQRAIGESSALVAEGRDMGTVVFPDARFKFFLDAAPEVRAMRRLRDLEERGEAAELTSLTEQIRQRDALDRNRAVAPLRPAPDALIVDTSHLDISGVLGVMLHHISVHGGPQSLRG

SEQ ID NO: 10141 - protein, 221 aa, Desulfomicrobium baculatum DSM 4028
MVTIVTLDGPAGVGKTTIARELADRLGIAYLDTGAMFRSVALYFGDGAWEQPVDQLVPELNRLDFDLEGLGKYSELLLNGMPLSPEIRKEEVGLWASHLGRIPVVRDFLRRNQQAIGRTTSLVAEGRDMGSVIFPNARHKFFMDASIDVRAKRRHAQLAALGMNEDLERIRGQIRIRDDQDRNRVVAPLKPALDAVIIDTSALDADRVLEKIVEHIREKGL

SEQ ID NO: 10142 - protein, 233 aa, Desulfohalobium retbaense DSM 5692
MPAKRPLIVTLDGPAGAGKSTVAKAVADALEIAYLDTGAMFRSVAWALGADSWQMDHESLVRALESMEFDLHGQGPASYLTLNGQPMGADIRTETVGMWASHIAQLLPVREKLKQDQRRLGAKRDLVAEGRDMGSVVFPEACCKFFLVASAEERARRRWEQLRQMGQDPSYEGLVQQIRQRDAQDSQREFAPLRAAEDAMEIDTTTRSAQEVVERIVELVQRRRKGTPGMPGE

SEQ ID NO: 10143 - protein, 135 aa, Ralstonia solanacearum
MRTKTTLCLMLIGGAVLVACGQKETAAPASAAVAAQVQSGTPATAAAAPAPENALGKRTYGSVCSMCHAAGVAGAPKPGDKADWGPRVAQGKDTLYKHALEGFNGNTGAMPARGGSTLPDDAIKAAVDYMVARSQ

SEQ ID NO: 10144 - protein, 128 aa, Rhodoferax ferrireducens T118
MNKPTLLLATLSLAFLAACGQKDAPAPATAPAPVAAPAPAPVAENTVGKSVFGRVCAMCHAVGAAGAPKPGDKADWGPRIAQGNDVLYKHALEGFTGAKGQMPARGANATLTDDEVKAAVNYMADQAR

SEQ ID NO: 10145 - protein, 137 aa, Cupriavidus metallidurans CH34 uid250
MRIKTLLLTLICGAALAACGQKESAAPAPAEATAAPAPAAAPAATAATTSEPENALGKRTYGSVCSMCHAAGVAGAPKPGDKADWGPRIAQGNDTLYKHALEGFTGSKGSMPARGGSTTLQDDAVKAAVDYMTAQSR

SEQ ID NO: 10146 - protein, 159 aa, Acidovorax sp. JS42
MPFWFWTSTRKAFMKKTSLTMALAAATLLLAACGKNDAPAPAPAPAPAAQAPAPAPTPAPAPAAQAPAAAPATAENTVGKSVYGKTCAMCHAAGVAGAPKPGDKADWAPRIAQGKDTLYKHAIEGFTGSKGMMPARGGAASLSDDEVKAAVDFMADQSM

SEQ ID NO: 10147 - protein, 140 aa, Ralstonia pickettii 12J
MRTKTTLGLMLICGAVLAACGQKEPAAPAASTAAAPAPVQTSTPPAATTVAAAAEPENALGKRTFANVCSMCHAAGVAGAPKPGDKADWGPRIAQGKDTLYKHALEGFNGNKGAMPARGGSTLPDDAIKAAVDYMVAKSQ

SEQ ID NO: 10148 - protein, 159 aa, Diaphorobacter TPSY uid29975; identical to SEQ ID NO: 10146

SEQ ID NO: 10149 - protein, 140 aa, Ralstonia pickettii 12D; identical to SEQ ID NO: 10147

SEQ ID NO: 10150 - protein, 86 aa, Nitrobacter hamburgensis X14
MKKPSRQIRDEIARLQEQLKQAETREAERIGRVALKAGLGEIEIEETMLLSAFEEVASRFRKSGGRTSKAATGVASGASAGAPQEG

SEQ ID NO: 10151 - protein, 98 aa, Sinorhizobium medicae WSM419
MKKPSSKIREEIGKLQEQLKQAETREAERIGRIALKAGLGEIEIDETELQDAFEHLARRFRGELAASIGGRKRVEDGIPSTATATVASGAAQGGHGEV

SEQ ID NO: 10152 - protein, 120 aa, Methylobacterium radiotolerans JCM 2831
MARLQSRKTILKEIAALQEKLKEHDKAQAERIGRLALRSGLATLDIPEASLMAEFEILATRFRQQAAAEPQQTGEESQGEGSEADGIGDPGSSSTDASDAEAATDPAPAAVGKTARERAA

SEQ ID NO: 10153 - protein, 92 aa, Methylobacterium chloromethanicum CM4
MARSKSRETIVNEITALQAKLRAHDKAEAERLGNLAIKSGIGAIDISDDELAREFQAIVARFREGASKVEEPKAKGSRGAGKAPEGADDEAA

SEQ ID NO: 10154 - protein, 98 aa, Agrobacterium vitis S4
MKKPSLKIREEIARLQDQLRQAETREAERVGRIALKAGLGEIEIEETELQAAFEEITGRFRGGKAASTGKRNAGDGRTAGETVTTIETGAAASSGREA

SEQ ID NO: 10155 - protein, 125 aa, Agrobacterium vitis S4
MHIPIHDIRRNSGVASATPESQGEPTGMKKPSSKIREEIARLQDQLKQAETREAERIGRIALKAGLGEIEIEEAELQAAFEEVAKRFRGGKGSATGKRQAGDSRTGREPSATLAPRADEGGPGEA

SEQ ID NO: 10156 - protein, 98 aa, Rhizobium leguminosarum bv  trifolii WSM1325
MKKHSSKIRDEIAKLQEQLKTAETREAERIGRIALKAGLGEIETDENELQAAFEHLAERFRRGEVVPAEGKGANEHGRKGAQATPVASGTAAGGDSEA

SEQ ID NO: 10157 - protein, 222 aa, Polaromonas JS666
MNLDTAQLIALAGVLGWASGVRLYLVVFLTGLAGFMGWVTLPPGLQMLAHPVVLGVSGFMVFMEFFADKIPGVDSLWDVVHTVIRIPAGAALAAGVFGADSGMMALIAALLGGTLAATSHAAKATTRAAINTSPEPFTNVGASLLEDGLVPLGLWLAIAHPLVFALMLALVLVASVWLIRICWRFLMQLFTRVARIFSGKPDPGLSPAFTLKSPFSKNDPHV

SEQ ID NO: 10158 - protein, 202 aa, Acidovorax avenae citrulli AAC00-1
MPGLLALAAGLGWASGFRLYAVVFLVGAMGAGGWLALPEGLRMLQHPAVLLVSGLLLCVEFVADKVPWFDNLWDAAHAVIRVPAGALLAAGVFGPDNGGMALAAGLLGGSLSATALATKMTARAAVNTSPEPVSNWLLSFFEDGLVVVVVWLATQHPFAFGIALACMVALSVLVLVVLLKFLRAVLRRLSAFFSRPAAPATR

SEQ ID NO: 10159 - protein, 239 aa, Acidovorax sp. JS42
MDAFWLQIVQWLHSVGLHVDAGTAQAVAEGAARATQQLDMPALLALAAALGWASGFRLYAVVFLVGMMGLAGWLPLPPGLALLQHPLVLMASGFMLLVEFFADKVPWFDSAWDAIHAFIRVPAGALLAAGVFGADNATMALAAGLLGGSLSATALATKMTTRAAANTSPEPFSNWGLSFFEDGLVVGVVWLATQYPLAFGIALAVMLALSALLLVVLFKFLRAVLRRISSFFSDSAKVA

SEQ ID NO: 10160 - protein, 223 aa, Polaromonas naphthalenivorans CJ2
MQALDTAQLIALAGALGWASGVRLYLVMLLTGLAGYMGWMELPQGLHLLANPVVLGASGFMVFVEFFADKIPGLDSLWDVVHTVIRIPAGAALAAGVFGADSSAMGLAAALVGGTLAATSHAAKATSRAAINTSPEPFTNIGTSLVEDSLVPAGLWLAIAHPLVFIPLLALVLVLSIWLIRLCWRFLTQLFARVARIFSGKPDAGLPPAFTLKSPFSKNDPHV

SEQ ID NO: 10161 - protein, 214 aa, Methylibium petroleiphilum PM1
MELPAVNALDTTHLIALAAALGWASGLRLYAVLAITGLVGYAGWVQLPPGLQLLQHPAMLAGSGFMLFVEFFADKIPGLDSLWDLVHTAVRIPAGAALAASVFGADHATAAALAALLGGTLAATSHVAKATTRAAVNTSPEPFSNIGMSLLGDLAVPSMLWLAFEHPVLAIAGVAAAFVGMLILVWLLSKFLARLWARLKMLLGAASATATESR

SEQ ID NO: 10162 - protein, 249 aa, Delftia acidovorans SPH-1
MSTLTDSLVQWLQSVGLYPGPAVHHTVSEAAGEVAERVGQATSGMDMAGLLALAAALGWASGFRLYAVVFVTGLLGALGWVALPGGLHVLEHPALLFASGALLFVEFFADKIPGVDSVWDLLQSVIRIPAGAALAAGVFGADSATMATMAALMGGSLALSSQVAKSTARAAINTSPEPFSNVGASLVEDGASVGAIWLALTHPLAFAAVLLVVVIALWLLTWALWRFLKAVVQRLRALLGGSPAMNQKP

SEQ ID NO: 10163 - protein, 239 aa, Diaphorobacter TPSY uid29975
MDALWLQIVQWLHSVGLHVDAGTAQAVAEGAARATQQLDMPALLALAAALGWASGFRLYAVVFLVGMMGLAGWLPLPPGLALLQHPLVLMASGFMLLVEFFADKVPWFDSAWDAIHAFIRVPAGALLAAGVFGADNATMALAAGLLGGSLSATALATKMTTRAAANTSPEPFSNWGLSFFEDGLVVGVVWLATQYPLAFGIALAVMLALSALLLVVLFKFLRAVLRRISSFFSDSAKVA

SEQ ID NO: 10164 - protein, 223 aa, Variovorax paradoxus S110
MNALDMPQLLALAAAIGWASGVRLYLVVLLTGLAGYFGWVPLPSGLQLLAHPVVIAASGFMVFIEFFADKIPGLDSLWDVVHTAIRIPAGAALAASVFGADHGAMAIVAALVGGGFAATAHAAKATTRAAINTSPEPFSNVGASLVEDTMVPTGLWLAVAHPLVFLVLFVLVLVLSVWLIRKSWRFLKALFTRVARIFSGRPDPGVTPAFQLKKNPPGDTPNV

SEQ ID NO: 10165 - protein, 87 aa, Nitrobacter winogradskyi Nb-255
MTGAETLDVARDAIWTIVLVSGPLLGVGLIVGVAISLVQALTQIQEQTLVFVPKILAIFVTLVLALPFMADALHAEMLRISSRIIGG

SEQ ID NO: 10166 - protein, 87 aa, Rhodopseudomonas palustris HaA2
MTGAETLDIAREAVWTIVIVSAPLMVVGLVVGVAVSLVQALTQIQEQTLVFVPKILAMFLTLVLTLPFMADRLHAEMLRISSRIVGG

SEQ ID NO: 10167 - protein, 88 aa, Jannaschia CCS1
MDEMIFFDTMRQGLWISVVVATPILAAALVSGIVVGLFQALTSVQEMTLTFVPKLAAIVVVFWVSMGFMSQTLVSYFTDTLVPIIAGM

SEQ ID NO: 10168 - protein, 87 aa, Rhodopseudomonas palustris BisB5
MTGPETLDVARDAVWTIVIVSTPLMVVGLVVGVAVSLVQALTQIQEQTLVFVPKILAMFLTFVLTLPFMADVLHAEMLRISSRIIGG

SEQ ID NO: 10169 - protein, 87 aa, Nitrobacter hamburgensis X14
MTGAETLDVARDAIWTIVLVSGPLLGVGLIVGVVISLVQALTQIQEQTLVFVPKILAIFVTLVLALPFMADALHAEMMRISSRIIGG

SEQ ID NO: 10170 - protein, 92 aa, Ruegeria sp. TM1040
MLTEGIFYDTLRQGILAAITMSLPILIAALVIGLTVGLFQALTSIQEMSLTFVPKLAGILVVFWLTMATMTQTLVAFFTGHVIPLIQGTGGL

SEQ ID NO: 10171 - protein, 84 aa, Rhodospirillum rubrum ATCC 11170
MIMDVARDAILTMLIISAPPLLAGMVIGLIIALFQTLTQIQEMTLVFVPKIVVVFASLLLTLPWMVRQASEFMERLMDIVTTLD

SEQ ID NO: 10172 - protein, 88 aa, Rhodobacter sphaeroides 2 4 1
MSELALYDALRQGLWVAVLISSPLLGVALVAGVTIGLLQALTSVQEMTLTFVPKVGAMLLVFWVSMSFMTTTLVAFFTDSIVPRIEGR

SEQ ID NO: 10173 - protein, 88 aa, Paracoccus denitrificans PD1222
MDENLIFDLTRQALWIAVRMSAPLLIVALVTGVVIGLFQALTSVQEMTLTFVPKIGLMLVVFWVSMSFMTATLASFFTDQILPQIAGS

SEQ ID NO: 10174 - protein, 88 aa, Rhodobacter sphaeroides ATCC 17029; identical to SEQ ID NO: 10172

SEQ ID NO: 10175 - protein, 88 aa, Rhodobacter sphaeroides ATCC 17025
MSEAALYDALRQGLWVAVLISAPLLTVALVVGVGIGILQALTSVQEMTLTFVPKVGAMLLVFWVSMSFMTTTLVAFFVEGIIPRIEGG

SEQ ID NO: 10176 - protein, 88 aa, Acidiphilium cryptum JF-5
MTDPAVITSLHEAFLVAAQLSAPPLLAALVAGVVISLLQAVTQINEATIVFLPKMAAVAGTLMIMGSFLLGTLSQFAHEIFTAMIHVG

SEQ ID NO: 10177 - protein, 87 aa, Bradyrhizobium BTAi1
MTGAETLDVARDAIWTIVLVSSPLMVVGLVVGVVVSLFQALTQIQEQTLVFVPKIIAIFVTLLLALPFMADALHSHMMRISSRIIGG

SEQ ID NO: 10178 - protein, 87 aa, Parvibaculum lavamentivorans DS-1
MSGPEVLDLARQAIYVQLIVSAPMMAVALLVGLAIALLQALTQVQEMTLVFVPKIVAIFLTMLISLPFMAQALSGFMTLVAQKIVTG

SEQ ID NO: 10179 - protein, 88 aa, Dinoroseobacter shibae DFL 12
MTEIIFFDTLRQGLWVSVLMSAPILTVALVAGVIVGLFQALTSVQEMTLTFVPKAALMLAVFWVSMSFMTETLTDFFQAEILPTIERF

SEQ ID NO: 10180 - protein, 87 aa, Rhodopseudomonas palustris TIE 1
MTGPETLDVARDAIWTIVVVSAPLMVVGLVVGVAVSLVQALTQIQEQTLVFVPKILAMFVTLVLALPFMADALHSQMMRISSRIIGG

SEQ ID NO: 10181 - protein, 91 aa, Gluconacetobacter diazotrophicus PAl 5 JGI
MHHTVDIHDILRQTLIVAVKMGAPSLLASLCAGVLVSLFQAMTQVNEATLSFVPKFVAAMAALLLTGSFMYSTLNTYAHVIFDQMVMVGGS

SEQ ID NO: 10182 - protein, 88 aa, Methylobacterium nodulans ORS 2060
MTGLAILDIARDGIVTFLKVGGPLMVVALIVGLAVSLLQALTQIQEQTLIYVPKIVAVFAAMLLMLPFMGDAMAGYMTRIAARIAAGG

SEQ ID NO: 10183 - protein, 109 aa, Moorella thermoacetica ATCC 39073
MWIPLIGLIVGVVAGLLLPVKIPVVYSKYMSVAVLAALDSVFGGLRASMEDNFDNAIFLTGFFSNTLLAAFLAYIGDQLGVELYLAAVLVFGVRLFQNLAIIRRHLLKR

SEQ ID NO: 10184 - protein, 95 aa, Syntrophomonas wolfei Goettingen
MQVPVFLSVVYAKYMSIAVIAALDAVFGGIRAYMEDNFDTTIFVSGFVVNTLLAAGMAYLGDRLGVQLYLAAVVVFGVRIFQNLGIIRRYLLKKY

SEQ ID NO: 10185 - protein, 125 aa, Clostridium thermocellum ATCC 27405
MIPLFGLIIGILIGIFIPYSIPEQYSSYVAVAILAALDSVFGGIVSTIQKKFDMGIFLSGFFGNALLAAALTYIGDKLGIQIYFAAIFAFGNRLFLNFAVIRRFLLNKLTKKDNIKDNMMETKEA

SEQ ID NO: 10186 - protein, 113 aa, Desulfotomaculum reducens MI-1
MWTGIILAAAGLTVGILVGLNVPLVLPQIYAQYLGLAVLAALDSVFGGVRAALENHYDNHIFITGFFSNILLAAGLAYIGTKLGVPLSTAAVVAFGVRLFQNLAIIRRYLLKK

SEQ ID NO: 10187 - protein, 108 aa, Herpetosiphon aurantiacus ATCC 23779
MWIPLAGLGVGVAIGLVSGLTIPSQFARYTAVAVLSALDSIVGATRATIEKRYRNRIFISGLIGNTVLAVVLAFLGERLGIDLYLAAVVAFGVRLFENASRIRQHLVG

SEQ ID NO: 10188 - protein, 114 aa, Thermoanaerobacter sp. X514
MAYIIIISLLIGIVIGFILPINIPSTYVSYLSVAILAALDSVFGGIRASLEEKFDNLIFITGFFGNAILAGGLAYIGDVLGVPIYLAAIFVFGSRLFVNFAYIRRYLIDKMRRR

SEQ ID NO: 10189 - protein, 120 aa, Clostridium cellulolyticum H10
MIPILGLILGIIVGLFIPITIPSEYFTYVAVAILAALDSVFGGIVAGINKKFEMRIFLSGFFGNALLAAGLAYIGDKLGIQIYFAAIFAFGNRLFLNFALIRRYLLNKMFKKDNIVKEDA

SEQ ID NO: 10190 - protein, 120 aa, Geobacillus WCH70
MWLPLIGLFVGLIVGFLSDLRVPDEYSNYLSIAILAAFDTLIGGLRAHLQQTYDEIVFITGFFFNIILATTLTFLGVHLGVDLYLAAVFAFGVRLFQNIAVIRRLLLAEWMERRQNREKS

SEQ ID NO: 10191 - protein, 125 aa, Desulfotomaculum acetoxidans DSM 771
MWLGVWLAVLGLFLGVMIGLNVPLILPSIYAHYMSVAVLAALDSVLGGIRSAMEDKFDNGIFLTGFFSNALLAAGLAFIGERLGIELYLAAVVAFGVRLFQNLAIIRRHLLKRSYVIKEENRLSR

SEQ ID NO: 10192 - protein, 125 aa, Alicyclobacillus acidocaldarius DSM 446
MYWLPVLGLAVGIGLGLVTNVVIPVAFTSYLSIAILAALDTVVGGIRASLDKTFDSAVFLSGFFTNTLVAALLAYIGNQLGVDLYLAAVVAFGVRLFQNIAVIRRHVFTLIRQRRVARRMASTKD

SEQ ID NO: 10193 - protein, 192 aa, Thermoanaerobacter sp. X514
MFYYIAKVIVRTIIKVIFRIEIRGLENIPKKGPVIICSNHISLLDPPVIGALLNRRIYFMAKEELFKNPFLRLLLGTGLGAFPVKRGTADLSAIKTALTYLKKGRAIGIFPEGTRSKTGQLQKAEPGVAMLAIKGNAPVVPIGIKGRYRLFSKIIINIGKPISFVKYANSKLSSKQLSVIGEEIMQEIAKLL

SEQ ID NO: 10194 - protein, 209 aa, Sulfurihydrogenibium YO3AOP1
MEKKAPYSEFGYKVFYKVRPALKKLLKINVVGLENIPLTGGCILAANHRSHLDPPVLNIISPRPIIFLAKKELFEVPILGWIIRKAGAIPVKRDNRDLSTIKKAISLLKEGYVIGIFPEGTRARPGEFRKPQPGVGYLIEKAKVPVIPILIEGTDKILPVKSKFPKLFKYNIDVIIGKPINFEGISSYEHVAEKVMHEIKKLKEVKRDG

SEQ ID NO: 10195 - protein, 211 aa, Dictyoglomus turgidum DSM 6724
MRQIRKSISHFFYKILIVVVRFLLNILWGYKVEGKENIPNHSFILVANHVSILDPIVIGAAFDKRLFYLAKKELFKSKIFNPFLRWLGAIDVDRKDFKYETWKKINRLIKENEIIVIFPEGTRNDHPEKGLLELKDGAASLALTHGLPILPVAIKGTEKIWKRKWIFPQLRGRINIRIGKVINVSKIKKPSKEDIKEVNNKIKASLIGLLR

SEQ ID NO: 10196 - protein, 191 aa, Anaerocellum thermophilum DSM 6725
MKYNFFLNLIRKVAFIILKCIFFIRVEGKENIPEGPFIICANHRSYLDPVLIILIFDRRVYFMAKSELFKIWWLAPIIKAFGAFPVKRGKSDIGAIKKAIEVIRSGNILGIFPEGKRNRTKEIILKGEKGVATVIKATGAKVLPVGISGKVVPFGRIKVRIGRPMEFRDNSMDNQEIVDTIMNEIKELILK

SEQ ID NO: 10197 - protein, 255 aa, Acidimicrobium ferrooxidans DSM 10331
MIEVGSLAQRAFYRGARELVRLANRAMFAVAVGFEEALPPAPYILAPTHRSNLDTPFIGSITGEPMTYMAKSGVMEAPGFGALLRLLGGFPVHREATDREAIELALAALGSGRSLVVFPEGTRRRGERVEGIEEGAAYLALRAGVPVVPAAIAGSERAMRPGSALILPAPVAIEVGRALWPGEVRASWAGRVRRQEIRQLSEMLESELNRLLAAARRSRALIVASGRRVASDPTQLPKLPPVHERSIRLDGTQAI

SEQ ID NO: 10198 - protein, 291 aa, Eggerthella lenta DSM 2243
MSLFLPYEKMWDMPLGGTSDEKQVPHWAGNLIWGFLAFVFKICFRYRVDHRESLRGFKDKTGVVVVGNHTSFLDVAFMYLAGRPSQWVRFLGRENLFGNAHGLVGQVLSRVGAFPIKRDAADRTAIKRATRMLKSNEIVGIMPEGTRRGKSDRTPELHSGAAFIAKMGHAPILPMTVRNAEHVKHKGERFRFPKITIEYGDPVLVEDFDFLPKEDRLDGCSWYAMRECFALSLNVPREQVDMPALFPGGKDFTAVFAEHPVPHHTTAEVVAGIEAKAAAKAAKAAKVQEVA

SEQ ID NO: 10199 - protein, 261 aa, Cryptobacterium curtum DSM 15641
MPHVYSPEELFDMPFMGTSTKKRAPHWLGNILWVIVVFLCKIFTRYRVHGIEHLRAFRGRSGAVVACTHASFLDIAYMYCPPRPGQWLRLMARDTLFENPITAFIFARCGGFPVTRDSADRASIKRAVRMLKEGELVGIFPEGTRRGKTSITPEVHGGAALIARMAKVPIIPAAVSNVERVKQKGHLPRPVRVDVHYGKPIDVSSFDFLPKEERLDGCMWYVMRECFALRDGINPEQVDMRVLFPDAKDYTEAFRAEQREG

SEQ ID NO: 10200 - protein, 268 aa, Slackia heliotrinireducens DSM 20476
MISYEKIWDMPVMTAAQRGQGDDKTEPYSSQVMGNIIYAVVGLICKVAFRYNAEGLENFRQFAGKQGCVVVSAHRSFLDPVFLWLTARPSQWIRFMARENIFPKANGLLGWICSKVGAFPIKRDSADRTAIKRAAAMLKRGENVGIFPEGTRRGRGTTKLSLHSGAAFIARMGKAPMVPTGIRNVENIKPPEARFVRFPKVTVVYGTPVNLEDFDFLPKAERLDAASWYVMRECYALHDGVPREDVDMASLFPEAKDYTQVFAEHAIP

SEQ ID NO: 10201 - protein, 158 aa, Pelobacter carbinolicus
MERPSWEEYFMEIARLVARRSTCLRRQVGAVLVKDKNILATGYNGTPSGLRHCSEVGCLRQLQNVPSGERHELCRGLHAEQNAIIQAAKHGTNISGAILFCTNTPCVICSKMIINAGIRQVVYLDGYPDHLSLDMLAESGVTVSALNDLLADKELSPL

SEQ ID NO: 10202 - protein, 155 aa, Desulfovibrio desulfuricans G20
MHSRLPWPHYFMDITYLVAERSTCTRRKVGAIAVKDKRILATGYNGAPSNVAHCLDVGCLREELGVPSGQRHEICRGLHAEQNVIIQAAIHGVSLAGAEIYCTTQPCLICTKMLINCGVTAVYFMEPYPDPLSEAMMREAGVKFEVLDYPQAGRK

SEQ ID NO: 10203 - protein, 135 aa, Moorella thermoacetica ATCC 39073
MRKEWDEYFLDIAFQVASRSTCNRLAVGAVVVKDKRIKGTGYNGAPHGLPHCLEVGCLMEGEHCLRTIHAEINALLECSPEERQGATMYVTDYPCERCALVIVQSGIKRLVYARPYHVNHDWLLEAGIEIVHLPR

SEQ ID NO: 10204 - protein, 156 aa, Syntrophomonas wolfei Goettingen
MFGERPDWDEYFLQLADLVATRSTCLRRQVGAVLVKNERIISTGYNGAPRGLEHCLDIGCLREEQGIPSGHRYELCRGVHAEQNALINAAYYGISTAEAVIYCTNQPCIICARMIINAGIIRIVHRGNFDDDLAIKFLKEAGIELVLIPRQANHSR

SEQ ID NO: 10205 - protein, 176 aa, Desulfovibrio vulgaris DP4
MSRMPWPDYFMQITYLVAERSTCTRRKVGAIAVKDKRILATGYNGAPSNVAHCLEVGCLREQLGVPSGQRHEICRGLHAEQNVIIQAAIHGVSLTGSEIYCTTQPCLICTKMLINCGVRAVYYTESYPDSLAEAMLREAGVSYAVMDFKPAPASSARISGPCGCDGVACGCGTGEG

SEQ ID NO: 10206 - protein, 147 aa, Desulfotomaculum reducens MI-1
MRPSWDEYFMEITRVVATRSTCLRRKVGAVIVKDNRILATGYNGAPAGLTHCLEIGCLREKLGVPSGQRHELCRALHAEQNAIIQAAVHGTAIQGSIIYVTDQPCVMCSKMIVNAGIKKVIFAGDYPDDLSLQIFKEACIELVKATS

SEQ ID NO: 10207 - protein, 155 aa, Candidatus Desulfococcus oleovorans Hxd3
MDKPHTDKPARPDWHTYFMEITELVARRSTCLRRHVGAVIVKNKRMLATGYNGAPAGVTHCSETGCLRARLNVPSGERHELCRGIHAEQNAIIQAAFHGVSIQGASLYCTNQPCSICAKMIINAGISAVYYKDGYDDPMSLEMLAEAGVELIRLP

SEQ ID NO: 10208 - protein, 182 aa, Desulfovibrio vulgaris  Miyazaki F
MSALSRLPWPQYFMEITYLVAERSTCTRRKVGAIAVKDKRILATGYNGAPSGVAHCLDVGCLRTQLGVPSGQRHEICRGLHAEQNVIVQAAIHGISLAGSEIYCTTQPCLICTKMLINCGVTAIRYAESYPDQLAEDMLRESGVRYEVLPFTPRTGSPCLPPDAPAPDHGGGCGGGCACGGR

SEQ ID NO: 10209 - protein, 158 aa, Desulfovibrio desulfuricans ATCC 27774
MQRLPWPEYFMNITYLVSGRSTCTRRRVGAVAVKDKRILATGYNGAPAGVPHCLEVGCLREQMGIPSGQRHEICRGLHAEQNVIIQAAVHGINISGAELYCTTHPCVQCSKMLINCGIRRIYYAEHYPDELATTMLKEAGIQLERLDFTPPAISPRPE

SEQ ID NO: 10210 - protein, 153 aa, Desulfomicrobium baculatum DSM 4028
MDNRIPWPQYFMSIAYLVAERSTCLRRKVGALAVKDKRILATGYNGAPAGLTHCLDLGCMREKLGIPSGQRHELCRALHAEQNVIIQAAIHGVGIEGADIFCTTQPCILCAKMLINCRVRAIFFAEGYPDEMSREMLDEAKIPYTRLEKPADA

SEQ ID NO: 10211 - protein, 154 aa, Desulfotomaculum acetoxidans DSM 771
MKRISWHEYFMGQAKIIALRSSCSRLSVGCLIVRDRRSIAGGYNGSVSGDVHCLDDGCRIDNGHCVRCVHAEANAIVQCAKFGASTEGTDIYVTHFPCLNCAKLIIQAGIRHVYYEQDYRIDPYCMELFNLVGVKVTKITCNLSDYLKLTDSNL

SEQ ID NO: 10212 - protein, 153 aa, Desulfohalobium retbaense DSM 5692
MTPRLPWPDYFMRIAHLVAERSTCLRRRVGAIAVKDNRILATGYNGAPAGLAHCLDIGCLREKMGIPSGERHELCRGLHAEQNVIIQAAVHGIPLKGAEIFCTTQPCLICTKMLINSNITAIYFAEGYPDALAREMLEEAGVVYERFTPAAER

SEQ ID NO: 10213 - protein, 90 aa, Ralstonia solanacearum
MSGPDSFAAGFEVPLHRSLTEPILMGGAPRTVAIANGTLAAAVGLGLQLWIPGVVLWIVGHSMAVWGARVDPQFMQVFARHIKHKSLLDV

SEQ ID NO: 10214 - protein, 91 aa, Novosphingobium aromaticivorans DSM 12444
MEGAPSGLPLGYAVPVHRALTEHILLGGAPRGLAIANATLAGAIGLGLRLWIAGLVLFTLGHMVAVWAARRDPQFVDVARRHLRFPNYLRV

SEQ ID NO: 10215 - protein, 87 aa, Rhodopseudomonas palustris BisB18
MEETIPGFAAPVHRALTEHILLGGAPRAVAILNGTLAAALGLGLRLWLAGLLLAFLGHAAAVWAAKRDPQFVDVVRRHLRIPGHLSV

SEQ ID NO: 10216 - protein, 93 aa, Rhodopseudomonas palustris BisB18
MDASATAEQPIPGFTVPVHRALTEPILLGGAPRAVAILNGTLAAALGLGLRLWLAGLVLWVIGHGAAVWATKRDPQFVDVVRRHLRISGHLSV

SEQ ID NO: 10217 - protein, 90 aa, Cupriavidus metallidurans CH34 uid250
MSGPDTFAAGFEVPLHRSLTEPILLGGAPRTVAIANGTLAAAVGLGLQLWIPGVVLWIVGHSLAVWGARVDPQFMAVFARHIKHRPLLDV

SEQ ID NO: 10218 - protein, 90 aa, Cupriavidus metallidurans CH34 uid250
MSAPDTFADGFEVPLHRSLTEPILLGGAPRTVAIANGTLTAAVGLGLQLWIPGVVLWIVGHSLAVWGARVDPQFMQVFARHIKHRPLLDV

SEQ ID NO: 10219 - protein, 89 aa, Sphingopyxis alaskensis RB2256
MNSADDIPGYYAPVHRALCEPILLGGAPRSLAIVNGTLAGAIGLGLRLWIAGLALWAIGHALSVWAARRDPQFVDVARRHLKYPVWMRP

SEQ ID NO: 10220 - protein, 89 aa, Rhodospirillum rubrum ATCC 11170
MAGTDPIDGFSVPVHRALTEPILLGGAPRTLAIANATLAAAIALGLRLWIPGLVLWLLGHGAAVWAAKHDAQFVEVIRRHLRYPAYLRA

SEQ ID NO: 10221 - protein, 93 aa, Mesorhizobium BNC1
MAGLLHHPDEVAGFSVPVHRALTEQILLGGAPRSIAIMNGTLAGAVGLGLRLWLVGLLIWAIGHFAAVWAAKRDPLFVEVGRRHLRIPGHLSV

SEQ ID NO: 10222 - protein, 93 aa, Mesorhizobium BNC1
MAGVLEQAAEVPGFTVPVHRALTEHILLGGAPRSIAIMNGTLAGAVGLGLRLWLVGLAIWAIGHFAAVWAARRDPLFVEVGRRHLRIPGHLTV

SEQ ID NO: 10223 - protein, 93 aa, Mesorhizobium BNC1
MNGLGDHTGPIAGFFAPVHRSLTEPILLGGAPRAVAIANGTIAAAIALGLRLWLAGLVIWAIGHFAAVWAARRDAQFMDVTRRHLRYPSFMRA

SEQ ID NO: 10224 - protein, 94 aa, Burkholderia ambifaria AMMD
MTAANEGAPAFASGFEIPLHRSLTEPILLGGAPRTVAIANGTLAAAVGLGLQLWIPGVVLWIVGHSLAVWGARVDPQFMQVFARHIKHKPLLDV

SEQ ID NO: 10225 - protein, 89 aa, Shewanella sp. ANA-3
MSTANDLPGFEVPLHRSLTEPILLGGAPRTVAIANGTLAAAVGLGLQLWIPGVVLWIVGHSLAVWGARVDPQFMQVFARHIKHKPLLDV

SEQ ID NO: 10226 - protein, 97 aa, Paracoccus denitrificans PD1222
MSGSEWQSFETLDAVPGFSVPVHRALTEPILLGGAPRSVAILNGTLAGAVGLGLQLWLVGILIWAVGHIAAVWAARRDPLFVEVARRHLRIPGHLSV

SEQ ID NO: 10227 - protein, 93 aa, Paracoccus denitrificans PD1222
MSAGFEQLSEVPGFSVPVHRALNEPILLGGAPRSIAILNGTLAGAVGLGLQLWLAGILIWAVGHLATVWAAKRDPLFVEVGRRHLRLPGHLAV

SEQ ID NO: 10228 - protein, 89 aa, Acidovorax avenae citrulli AAC00-1
MSKATDLPGFEVPLHRSLTEPILLGGAPRTVAIANGTLAAAVGLGLQLWIPGVVLWIAGHSLAVWGARVDPQFMQVFARHIKHKPLLDV

SEQ ID NO: 10229 - protein, 90 aa, Acidovorax sp. JS42
MNGPHDGIPGFEVPLHRSLTEPILMGGAPRTVAITNGTLAAAVGLGLQMWIPGLVLWIVGHSLAVWGARVDPQFMAVFARHIKHRPLLDV

SEQ ID NO: 10230 - protein, 94 aa, Polaromonas naphthalenivorans CJ2
MSTETEFAQGFASGFEIPLHRSLTEPILLGGAPRTVAIANGTLAAAVGLGLQLWIPGLVLWIVGHSLAVWGARLDPQFMAVFSRHIKHRPLLDV

SEQ ID NO: 10231 - protein, 87 aa, Bradyrhizobium BTAi1
MDGQIPGFEAPVHRALTEPILMGGAPRSIAIVNGTLAAALGIGLRLWVAGLLLWFVGHMVAVWVTKRDPAFVEVVRRHLRIPGYLNT

SEQ ID NO: 10232 - protein, 89 aa, Bradyrhizobium BTAi1
MEQDGAIAGFYAPVHRALTEPILLGGAPRAVAIVNGTLAAAIGLGLRLWIVGGLIWLVGHIAAVWAAKRDAAFVDVVRRHLRYPQHMVS

SEQ ID NO: 10233 - protein, 166 aa, Bradyrhizobium BTAi1
MGAAASADPAIDRRPGGQGHRGDHHHRHWPDARLRRYERRLPQARADRLWPVDRIRSQLLLPELLQLRRWGGGVMAGVLETAEVPGFSVPVHRALTEPILLGGAPRSIAILNGTLAAALGLGLRLWLVGLGLWAVGHFAAVWAAKRDPMFVEVTRRHLRIPGFLGV

SEQ ID NO: 10234 - protein, 93 aa, Sphingomonas wittichii RW1
MTGAADPVEPIAGYFAPVHRALTEPILLGGAPRSLAIVNGTLAGAIGLGLRLWIAGLAIWAIGHALSVWAARRDPQFVDVARRHLRYPAWMRP

SEQ ID NO: 10235 - protein, 90 aa, Pseudomonas aeruginosa PA7
MSAPDTFADGFEVPLHRSLTEPILLGGAPRTVAIANGTLAAAVGLGLQLWIPGMVLWIVGHSLAVWGARVDPQFMAVFARHIKHRPLLDV

SEQ ID NO: 10236 - protein, 93 aa, Ochrobactrum anthropi ATCC 49188
MAVSFEALDAVPGFSVPVHRALTEPILLGGAPRSVAILNGTLAGAVGLGLQLWLAGILIWAVGHIAAVWAAKRDPLFVEVARRHLRIPGHLSV

SEQ ID NO: 10237 - protein, 93 aa, Parvibaculum lavamentivorans DS-1
MAAAFEQLDAVPGFTVPVHRALTEHILLGGAPRALAILNGTLAGAVGLGLRLWLVGLLIWAIGHIAAVWAAKRDPLFVEVGRRHLRIPAHLSV

SEQ ID NO: 10238 - protein, 90 aa, Xanthobacter autotrophicus Py2
MAGDAGEVPGFSVPIHRVLSEPILLGGAPRALAIFNGTLAGAVGLGLRLWLVGLALWAIGHLTAVWAAKRDPLFVDVVRRHLRISSHLSV

SEQ ID NO: 10239 - protein, 93 aa, Xanthobacter autotrophicus Py2
MASLIDSAGEVPGYAVPVHRALTEHILLGGAPRSIAILNGTLAAALGLGLRLWLVGLGLWAIGHFAAVWAAKRDPQFVDVVRRHLRIPGHLSA

SEQ ID NO: 10240 - protein, 93 aa, Xanthobacter autotrophicus Py2
MASLTDSVGDVPGFAVPVHRALTEHILLGGAPRSIAILNGTLAAALGLGLRLWLVGLGLWAIGHFAAVWAAKRDPQFVDVVRRHLRIPGHLSA

SEQ ID NO: 10241 - protein, 90 aa, Xanthobacter autotrophicus Py2
MAGVADDVPGFTVAVHRALSEPILLGGAPRAIAIMNGTLAGALGLGLRLWLVGLIVWAIGHFAAVWAAKRDPLFVDVGRRHLRIPAHLSV

SEQ ID NO: 10242 - protein, 90 aa, Xanthobacter autotrophicus Py2
MPGDIGGVPGFSVPVHRALSEPILLGGAPRAIAIFNGTLAGAVGLGLRLWLVGLAVGAVGHLAAVWAAKRDPLFVDVVRRHLRIPGHLSV

SEQ ID NO: 10243 - protein, 90 aa, Delftia acidovorans SPH-1
MSAPDTFADGFEVPLHRSLTEPILLGGAPRTVAIANGTLAAAVGLGLQLWIPGVVLWIVGHSLAVWGARVDPQFMQVFARHIKHRPLLDV

SEQ ID NO: 10244 - protein, 90 aa, Delftia acidovorans SPH-1
MSAPDTFAAGFEVPLHRSLTEPILLGGAPRTVAIANGTLAAAVGLGLQLWIPGVVLWIVGHSLAMRGARVDPQFMAVFARHIKHRPLLDV

SEQ ID NO: 10245 - protein, 94 aa, Burkholderia multivorans ATCC 17616 JGI
MSAANEGAPGFASGFEIPLHRSLTEPILLGGAPRTVAIANGTLAAAVGLGLQLWIPGAVLWIVGHSLAVWGARVDPQFMQVFARHIKHKPLLDV

SEQ ID NO: 10246 - protein, 94 aa, Caulobacter K31
MTGPATSSGVGVSGFEIPLHRALTAPILLGGAPRSIAILNGTLAGALGLGLQQWIPGLVVWVIGHSLAVFAAKRDPDFAPVLMRHLRQKGWLRC

SEQ ID NO: 10247 - protein, 93 aa, Caulobacter K31
MAGMVDHAAEVPGFSVPVHRALTEHILLGGAPRAIAILNGTLAAALGLGLRLWLVGLGLWALGHFTAVWAAKRDPMFVDVVRRHLRIPGHLGV

SEQ ID NO: 10248 - protein, 90 aa, Methylobacterium populi BJ001
MADAADEVPGFTVPIHRALTEPILLGGAPRAIAIMNGTLAGAVGLGLRLWLVGLAIWAIGHFAAVWAAKRDPLFVDVGRRHLRIPAHLTV

SEQ ID NO: 10249 - protein, 94 aa, Ralstonia pickettii 12J
MSAAHDGVQGFAPGFEVPLHRSLTEPILLGGAPRTVAIANGTLAAAVGLGLQLWIPGLVLWIAGHALAVWGARVDPRFMQVFARHIKHRPLLDV

SEQ ID NO: 10250 - protein, 83 aa, Prosthecochloris aestuarii DSM 271
MSEEYSVPVHRSLAEVILIGGLPRTVAILLWTTAGAAGFGMQQLWVLPVAIVLHVVLAMTAKRDPHFFDVFVRALKSPKRLDP

SEQ ID NO: 10251 - protein, 88 aa, Gluconacetobacter diazotrophicus PAl 5 JGI
MEPDSIPGFTAPVHRALIEPILLGGAPRTVAIVNGTLAAAIGLGLRLWIAGGLFWLVGHFAAVWAAKRDPAFVDVVRRHLRYPTHLVG

SEQ ID NO: 10252 - protein, 91 aa, Gluconacetobacter diazotrophicus PAl 5 JGI
MAAIVDPDVPGFFAPVHRALTDPILMGGAPRTVAIANGTLAAAIALGLRLWIPGALIWAVGHAAAVWAAKRDPQFVDVVRRHLRYPAHLGV

SEQ ID NO: 10253 - protein, 90 aa, Thioalkalivibrio HL EbGR7; identical to SEQ ID NO: 10217

SEQ ID NO: 10254 - protein, 99 aa, Agrobacterium vitis S4
MAEGTSRLDRVRIHRALSRPALLFGADRELVLMTGLTAVILIFVVLTLVSAAVGFIIWIVVVGLLRMMAKADPLMRQVYLRHMKYRSHYRPTSSPWRKH

SEQ ID NO: 10255 - protein, 90 aa, Diaphorobacter TPSY uid29975
MSGPDTFAAGFEVPLHRSLTEPILLGGAPRTVAIANGTLAAAVGLGLQLWIPGVVLWIVGHSLAMWGARVDPQFMAVFARHIKHRPLLDV

SEQ ID NO: 10256 - protein, 94 aa, Azotobacter vinelandii DJ
MSAANEGAPGFAPGFEIPLHRSLTEPILLGGAPRTVAIANGTLAAAVGLGLQLWIPGVVLWIVGHSLAVWGARVDPQFMQVFARHIKHRPLLDV

SEQ ID NO: 10257 - protein, 84 aa, Geobacter M21
MAREGYEIPIHRSLIQPILIGGVPRTIALINGTLVAALGLGLHSLLAVPVGLVIHFLALAATRADPEFLSCFRRHVRQKNIYTV

SEQ ID NO: 10258 - protein, 103 aa, Bacillus cereus ATCC 10987
MGHCEGSEINPKMVPRTEEEIQNVIKRLKRIEGQVRGVQKMVEDNRYCVDILIQISAINAALNKVGFSLLERHTKHCVAKAINKGDGDESIQELMSVIRQFSK

SEQ ID NO: 10259 - protein, 100 aa, Bacillus anthracis Ames 0581
MDHKEHEAVTHRSEKEKEQIINRLKRIEGQVRGIQNMIENDRYCVDILVQISAINAAMKKVGMGVLKNHTSHCVSGAIKDGNGDEAIEELMTVFERFSKA

SEQ ID NO: 10260 - protein, 100 aa, Bacillus anthracis str Sterne; identical to SEQ ID NO: 10259

SEQ ID NO: 10261 - protein, 100 aa, Bacillus thuringiensis konkukian; identical to SEQ ID NO: 10259

SEQ ID NO: 10262 - protein, 100 aa, Bacillus cereus ZK; identical to SEQ ID NO: 10259

SEQ ID NO: 10263 - protein, 95 aa, Thermobifida fusca YX
MAAYGYHDNKRQHLNRLRRIEGQVRGLQRMVEDDAYCIDILTQTSAVTKALQSFALSLLEEHLHHCVANALANGGREAETKVREASEAIARLVRS

SEQ ID NO: 10264 - protein, 92 aa, Nitrosospira multiformis ATCC 25196
MPTAVVQPDKEALIKRLNRIEGQVRGVAKMITEDRYCVDILNQVSALQSALDAVAMRLLENHTHGCMQSAIKSGDGDAAIDELMTVVRRFAR

SEQ ID NO: 10265 - protein, 121 aa, Anaeromyxobacter dehalogenans 2CP-C
MATKESKGTAALAACACATGEHVGPGGRAVAVDAGGKEANLKRLRRIEGQVRGLQRMVEEGRYCADVLTQIASVHEALRSVGRELMRNHLKHCATSAIQAGGPEADAMYDELLDLMYRQVR

SEQ ID NO: 10266 - protein, 108 aa, Rubrobacter xylanophilus DSM 9941
MREEGGVRQGQAHGYIKADHKENLLLRLRRIEGQVRGVQGMVEREEYCIDIITQISSLIAASERVAALVLKDHMEHCVRAAIEDGEQADRKIEELTAAVERFLKLDRR

SEQ ID NO: 10267 - protein, 96 aa, Alkalilimnicola ehrlichei MLHE-1
MAGCCQRLRLDDGAREDARQRLRSVRGHVDGILKMLDHPDTYCVDVLKQIKAVQGGLDRVGGLVLRAHLRDHVTTANERGDVEEMVEELMEVLKYR

SEQ ID NO: 10268 - protein, 96 aa, Alkalilimnicola ehrlichei MLHE-1; identical to SEQ ID NO: 10267

SEQ ID NO: 10269 - protein, 115 aa, Arthrobacter FB24
MDSAEDAGPRTVDAGTVPQHGYTSNKEAYLRRLKRIEGQVRGIARMVDEDKYCIDILTQVAAVNKALHAVSLGLVEEHIGHCVVGAASEPDPELRAEAIDFKVKEATDAIGRLLR

SEQ ID NO: 10270 - protein, 93 aa, Acidothermus cellulolyticus 11B
MVGYAGTKETVLARLRRIEGQVRGLHRMVEQDTYCIDVLTQISAATRALEAVALNLLEEHLRHCVHDAITAGGPEAEEKITEAADAIRRLVRS

SEQ ID NO: 10271 - protein, 97 aa, Mycobacterium vanbaalenii PYR-1
MDTKTPGYAASKDAHLKRLRRIEGQVRGLARMVDEDAYCIDVLTQISAATKALESVALSLLDEHLSHCVRDAVHQGGDIAEQKIDEASAAIARLVRS

SEQ ID NO: 10272 - protein, 110 aa, Desulfotomaculum reducens MI-1
MDQIEKTPCVGCQGNATNNRLSHHDERTIKELVNRINRIEGQLRGIKGMIERHVYCDEILNQISSANAALHGVAKLLLEKHMKSCILEQLQEGDEQVIDEVLKTIFKMMR

SEQ ID NO: 10273 - protein, 103 aa, Salinispora tropica CNB-440
MVRMTRPEPAPVRGYTATKDQLLTRLRRVEGQVRGIEKMVEEDRYCIDVLTQIAAIQAALDKVALGLLDGHARHCMREGAAEGRADEMATEMMAAVGRLMKRG

SEQ ID NO: 10274 - protein, 93 aa, Kineococcus radiotolerans SRS30216
MVGYDTHKDEVLKRLRRIEGQVRGLHRMVEEDTYCIDVLTQVSAATKALQAVALSLLDDHLAHCVADAARQGGEVADAKVKEASDAIARLVRS

SEQ ID NO: 10275 - protein, 56 aa, Bacillus cereus cytotoxis NVH 391-98
MNQEKMVPRTDEEIEKVVNRLKRIEGQVRGIQKMMEDNRYCIDVFIQISAVQSNVK

SEQ ID NO: 10276 - protein, 100 aa, Salinispora arenicola CNS-205
MTTPAPTPVRGYTATKDQLLTRLRRVEGQVRGIEKMVEEDRYCIDVLTQISAIQAALDKVALGLLDGHARHCMREGAAEGRADEMATEMMAAVGRLMKRG

SEQ ID NO: 10277 - protein, 100 aa, Bacillus weihenstephanensis KBAB4
MDHKDHESVTHRSEKEKEQIINRLKRIEGQVRGIQNMIENDRYCVDILVQISAINAAMKKVGMGVLKNHTSHCVSGAIKNGNGDEAIEELMTVFERFSKA

SEQ ID NO: 10278 - protein, 121 aa, Anaeromyxobacter sp. K
MGTKESKGTEALAACACATGEHVGPGGRAVAVDAAGKEANLKRLRRIEGQVRGLQRMVEEGRYCADVLTQIASVHEALRAVGRELMRNHLKHCATNAIQAGGPEADAMYDELLDLMYRQVR

SEQ ID NO: 10279 - protein, 100 aa, Bacillus cereus AH187
MGHKEHEAVTHRSEKEKEQIINRLKRIEGQVRGIQNMIENDRYCVDILVQISAINAAMKKVGMGVLKNHTSHCVSSAIKDGNGDEAIEELMTVFERFSKA

SEQ ID NO: 10280 - protein, 100 aa, Bacillus cereus B4264; identical to SEQ ID NO: 10259

SEQ ID NO: 10281 - protein, 100 aa, Bacillus cereus G9842
MDHKENEAVTHRSEKEKEQIINRLKRIEGQVRGIQNMIENDRYCVDILVQISAINAAMKKVGMGVLKNHTSHCVSGAIKNGNGDEAIEELMTVFERFSKA

SEQ ID NO: 10282 - protein, 100 aa, Bacillus cereus AH820; identical to SEQ ID NO: 10259

SEQ ID NO: 10283 - protein, 103 aa, Bacillus cereus AH820; identical to SEQ ID NO: 10258

SEQ ID NO: 10284 - protein, 125 aa, Arthrobacter chlorophenolicus A6
MDAIEEAMAAPPAEATQERAPEQSQHAVEHGYTANKDAYLRRLKRIEGQVRGIARMVDEDKYCIDILTQVSAVTKALHAVSLGLVEEHIGHCVVGAAAEPDPEARAEAIDAKVKEATEAIGRLLR

SEQ ID NO: 10285 - protein, 121 aa, Anaeromyxobacter dehalogenans 2CP 1
MATKESKGTAALAACACATGEHVGPGGRAVAVDAAGREANLKRLRRIEGQVRGLQRMVEEGRYCADVLTQIASVHEALRSVGRELMRNHLKHCATTAIQAGGPEADAMYDELLDLMYRQVR

SEQ ID NO: 10286 - protein, 93 aa, Beutenbergia cavernae DSM 12333
MPGYSGTKADYAKRMRRIEGQVRGIARMIDEDEYCIDVLTQVSAVTKALQAVSLGLLEDHLGHCVVDAARAGDEEGDAKVREAADAIARLVRS

SEQ ID NO: 10287 - protein, 93 aa, Beutenbergia cavernae DSM 12333; identical to SEQ ID NO: 10286

SEQ ID NO: 10288 - protein, 103 aa, Geobacillus WCH70
MNHREENQLNPKMVPRTEEEIEGIVKRLKRIEGQVRGVQKMVEDNRYCIDILIQISAIEAALHKVGLNLLERHVRHCVAKAIREGNGDESIQELMTVIQQFSK

SEQ ID NO: 10289 - protein, 126 aa, Micrococcus luteus NCTC 2665
MSTDSTTTAPAAASPLPSAAADACDGHRPPHEVHRDKAKHLARLRRIEGQVRGLHRMVDEDVYCIDVLTQIAAVTKALQSLSLNLTSEHLRHCVAEAAVQAEAEGRTELIDEKVAEATAALGRLLR

SEQ ID NO: 10290 - protein, 101 aa, Kytococcus sedentarius DSM 20547
MEHSEHDHHHGYITDKEAYLKRMRRIEGQARGIARMIEEEKYCIDILTQVSAVTSALEGVALGLLEEHLRTCVVDAARTGDAEADALVKEATAAITRLVRS

SEQ ID NO: 10291 - protein, 116 aa, Eggerthella lenta DSM 2243
MTENHAQAENAAISSRPASTCCCHRKETPRSEELQADLHRRLNRVIGQLGGVKTMIDDNRYCADVLTQLAAAESAVHSISAVVLRNHLETCVVEQIERGNVEIIDEVMNLLKKFSR

SEQ ID NO: 10292 - protein, 91 aa, Chloroflexus aggregans DSM 9485
MDPERKQQILNRLKTIEGHIRGVQRMVEEDAYCIDLLNQTRAIQQALAKLDAIILANHLHSCVTTAIRSEDVGERERVLTELLQVFESTHR

SEQ ID NO: 10293 - protein, 103 aa, Cryptobacterium curtum DSM 15641
MAERECPHCARQKHTPRSQDLQEDLQRRLNRAIGQLGGIKTMIEENRYCGDVLVQLSATRSAIQSIERIVLQNHLETCVVEEIRSGNDEIVDEAMDLIKRVAK

SEQ ID NO: 10294 - protein, 93 aa, Saccharomonospora viridis DSM 43017
MPGYTSDKDAYLKRLRRIEGQIRGLQRMVENDEYCIDVLTQIAAATKALQAVSLGLLEEHLRHCVAEAISEGGERADEKVREASAAIARLVRS

SEQ ID NO: 10295 - protein, 91 aa, Anaerococcus prevotii DSM 20548
MHADKKKTIRKLKTVGGQIDGLIKMIEDDRYCIDISNQIMASISILKNINKEVLQAHLEHCVYQSLNSDDEEDIRQKIEEIEKVIDKLNKI

SEQ ID NO: 10296 - protein, 141 aa, Jonesia denitrificans DSM 20603
MGVFFLLVLLDLIPPGGMLGVLVNWPPHEEGNAMTTEHIDDSTVTVPPSRGYSGTKEDYHKRLRRIEGQVRGIARMVEEDTYCIDVLTQVSAVTKALHAVSLGLLEDHIGHCVVNAAQSSPTEGQEKVAEAAAAIARLVRS

SEQ ID NO: 10297 - protein, 114 aa, Slackia heliotrinireducens DSM 20476
MGAENTEVQAAAEQAEHGCCCGRHKDTERSQEFQADLQKRLNRVIGQLNGVKRMIDDNRYCGDVLVQLAAAEAAIKRTSDIVLRDHLETCVTEQIKAGNTEIIDEVMDLMRKFR

SEQ ID NO: 10298 - protein, 107 aa, Atopobium parvulum DSM 20469
METRSAVEKKSCHHCGYKATPRSSELKSGVSRRINRAIGQLNGIKTMINEDRYCGDVLIQLAAVESAVKAISREVMQDHLESCVVDRIQSGDTEVIDEVMDLFKRFM

SEQ ID NO: 10299 - protein, 87 aa, Desulfotomaculum acetoxidans DSM 771
MENSKKDMLNRLKRIEGQVRGIHKMIEEDRYCVDIMLQISATRAALQKVALSLLGNHTRGCVADAFKKERGEEAIKELVQVLDKFMN

SEQ ID NO: 10300 - protein, 98 aa, Alicyclobacillus acidocaldarius DSM 446
MCPEHAGYSYAQHKKDLLRRLRRIEGQVRGLQKMIEEDRYCIDILVQISAIKSALHQVGLTILESHTRGCVADALANRDQGDEMVHELMDVIRQFTRA

SEQ ID NO: 10301 - protein, 99 aa, Alicyclobacillus acidocaldarius DSM 446
MEESHAHTHSYEPMKADLVRRLRRIEGQVRGLQKMVEDGRYCVDILVQIAAVKSALHQVGLSILESHTRGCVAEALRERDREEEKVDELIQVLRQFTKL

SEQ ID NO: 10302 - protein, 111 aa, Moorella thermoacetica ATCC 39073
MTPSGEKTLRGVRFLNEVERGTAFLADKVQQLITTIEKANVAEWVELYRRPGRLLYLNFAAGIARGLGIAVGFTILGAIVIYIIRELALLNLPVIGKLIAEIVRMVQQEVY

SEQ ID NO: 10303 - protein, 105 aa, Syntrophomonas wolfei Goettingen
MPEREPGRDDSHYLQELNRKMDELSLNMEKLGIAEYLEMLRNPRRLFFINFWAGLSRGFGMAIGFTILAAIVIYFLQKLIILNVPLIGDFIADLVAIVQNQLRVQ

SEQ ID NO: 10304 - protein, 103 aa, Thermoanaerobacter sp. X514
MNKDEYKNNNNIMLTAIKKQLDQMSEMMEKMKIADYVELMQSPYRLLWLNFIGGVARGFGIAVGFTILGAIILYILQKLVVLNLPVIGSIIADIVKIVNQKLY

SEQ ID NO: 10305 - protein, 100 aa, Candidatus Desulforudis audaxviator MP104C
MAREADNRVLWELKLKVRQLSVAMEKMRLAEYVALLDRPYRLLYINFLTGIARGLGIAVGFTILGAVVVLVLQRLVTLNLPLIGGFIADIVRAVEINLAR

SEQ ID NO: 10306 - protein, 100 aa, Natranaerobius thermophilus JW NM WN LF
MQDNNNNQKELLEKLYYQTAELLDKLEKFKLAEYMHYLNNPVRYFWINFWGGVARGLGIAVGMTVLGAILVYFLQQLVMLNLPIIGDFIADIVKIVQEHL

SEQ ID NO: 10307 - protein, 125 aa, Desulfitobacterium hafniense DCB 2
MTASKKKVRHAKEDPERIGQGTDEARLPNNEPLDWDELRDKVTELYLVLERINLTEYIAYLNNPRRLLWLNFGVGLVKGLGGAIGATLLLGLLVMFLRRLVLLNLPVIGGVIGEIVKLVNAHNGY

SEQ ID NO: 10308 - protein, 95 aa, Halothermothrix orenii H 168
MVTEDDKKEIMEKLDEISDRLQKLNIAEYIELVRSPRRMLLINFIAGLARGLGVAIGATFLGAIFLVILFRLARLNLPLIGEYIARIVKIVQTYL

SEQ ID NO: 10309 - protein, 100 aa, Clostridium cellulolyticum H10
MANKNHLFSVLCKKIDNLSLKMEKMKFVDYVYYLEHPRKMLWANFVSGLARGFGIAIGFTILGAIAIYFLNIIVKINLPYIGEFISDIVKIVQNSSRNVR

SEQ ID NO: 10310 - protein, 92 aa, Anaerocellum thermophilum DSM 6725
MSRDEFEEKLNDFILKLERMNFSYYIEYLKNPKKIIFTNFLSGAARGFGTAFGFSILGALLLYILNAIVKYNLPVIGRYIAEILKFVKFYMH

SEQ ID NO: 10311 - protein, 98 aa, Desulfotomaculum acetoxidans DSM 771
MHIENTLIKSLEKKLDKLSLDMEKMKLAEYVDLLEHTKKLLYINFISGVARGLGIAVGFTVLGALLIYLLRWLLVLNIPVIGGFIAEIIKIVQLRLGS

SEQ ID NO: 10312 - protein, 104 aa, Alicyclobacillus acidocaldarius DSM 446
MRHRRRRRHSLTHLGLLRLTEYLEGVNFAAYVDLLQTPWRLALLNLIGGIFRGLGIGLGFTVIAGLVVLILQQLELLNLPIIGKWIADLVQIVDGQLRARQFTY

SEQ ID NO: 10313 - protein, 139 aa, Frankia CcI3
MVDPRGMRFAAAVTTIMLAVILLAGSRWLLLAQTVVFGVGAVAGVRHAPYGLVFRSLIRPRLGPPAATEDAAPPRFAQLVGAIFGVVGLVGFFAGMPALGYVAVALAFVAALLNAAFEFCLGCQLYLFLHSIAVKGART

SEQ ID NO: 10314 - protein, 156 aa, Mycobacterium MCS
MSTSTDTASDPRVDVRGPRFAAWVTTGVLVATLVLSAVSPLAAAVLLGAQTVVFAIGARRGPRRHPYGIVFGRVIAPRLGPVTDREPAGPLKFAQLVGFVFAAVGTIGFAAEWSAVGLIATAFALFAAFLNAAFGICLGCKLYPLAARLRRVPTPA

SEQ ID NO: 10315 - protein, 161 aa, Nocardioides JS614
MSTTQQHHQADQAQRPAERRPAGIDPRGPQFAAALTSIALIVVLLLAPGPAAVVVLALQAAVFAVGATRGVQHTPYSWLFRTLVRPRLAVPDHLEDPAPPRFAQTVGLGFAVVALVGFLAGVDLLGLVATGFALVAALLNALFRFCLGCELYLLGRRITAH

SEQ ID NO: 10316 - protein, 156 aa, Mycobacterium KMS; identical to SEQ ID NO: 10314

SEQ ID NO: 10317 - protein, 153 aa, Mycobacterium vanbaalenii PYR-1
MSNITQSSAPTQIDVRGPRFVAWVTTVVLVATLLVSAQHPAAAAVLLGAQAVVFAIGAVSGPRRHPYGRVFAALIAPRLAPATDREPVAPLKFAQLVGFAFAVVGVLGFASGLAPLGLVATGFALVAALLNAAFGICLGCQLYPLVTRLNPTR

SEQ ID NO: 10318 - protein, 156 aa, Mycobacterium JLS; identical to SEQ ID NO: 10314

SEQ ID NO: 10319 - protein, 153 aa, Mycobacterium gilvum PYR-GCK
MSNITAADSPAQVDVRGPRFVAWVTTAVLVAALLISVQNAALAAALLGIQTLVFAVGAVAGPRRHPYGVAFAALIAPRLGPAREREPVAPLKFAQLVGFVFAALSTLGFAGGVMPLGLIATGLALAAALLNAAFGICLGCQLYPLIARLTPTP

SEQ ID NO: 10320 - protein, 139 aa, Frankia EAN1pec
MVDPRGPRFAAAVTTVVLAVTIITGNPWLLLAQTVVFLVGAVAGIRNAPYGLVFRYLVRPRLGPPAELEDEAPPRFAQAVGAVFGVVGTVGLLAGPAALGYSAAALAFAAAFLNAAFGFCLGCQTYLVLRSATVKGART

SEQ ID NO: 10321 - protein, 144 aa, Actinosynnema mirum DSM 43827
MPKDVPVDPRGARFSAWFTSAVLVLVLLTGSWRLLAAQTLLFAMCAFVSLRLNPWGHVYRRVLQPRLPEAEREDAAPLRFAQGVGFAFALVGTIGYAAGWTALGVVATSAALTAALLNAALGLCLGCELFLLVRRAAPAPAPRT

SEQ ID NO: 10322 - protein, 146 aa, Saccharomonospora viridis DSM 43017
MSAPASVDPRGPRFAAVVTTVVLAIVLFTEWWPLLAAQTVVFALGAFAGLRFAPYSVLYRALIAPKLRPTTEREDAAPLRFAQAVGFAFALVGTIGYATGLPTVGVIATAFALFAAFLNAAFNLCLGCEVYLLLQRVTPRTKRMNA

SEQ ID NO: 10323 - protein, 149 aa, Clostridium thermocellum ATCC 27405
MSDGIIRKNFVIPANDFTLAGEASSTVKKMLIQLGADPQKIKKTAISMYEAELNAVIHANGGVAEVEIDRNKVFIRIKDEGPGIPDLELAMQEGYTTAPDSIREMGFGAGMGLPNMKRYADKLEIITEVGKGTIVEITVFLTDNEKENH

SEQ ID NO: 10324 - protein, 321 aa, Thermotoga petrophila RKU-1
MSVSIIDRLQAIFQDVRVSEFMNPDVIYVTPDKTLLHVKEIMRIKRISGVPVVDDKKRVVGIVSLEDIIKALEGSYIKDSVEKRMTKNVVCLKETDTLQDAVKTFEKYGYGRFPVVDDEGKLVGIVTKHDIIYFLLAKLGIMYLHDKRMEEVLEKGTSLITGEVLEKGKADFVFHIDYFDVNMIGIGASKLKRFLLERGVDEELARRIAIATYEAEANVVIHSESDGYIYCFIDNEKITVRVEDRGKGIENLELAMREGYSTAPDHIRELGFGAGMGLPNMKRYSDKMVIISEVGKGVIVEMVFFRRDRGEDKGDSGKTGA

SEQ ID NO: 10325 - protein, 140 aa, Clostridium phytofermentans ISDg
MSQSITLTYTIPGDDFTRAGEASSDVKKKLKQMGANPEAIRKVAISMYEGEINMVIHAHGGDITVHISSTEIIMILKDEGPGIVDVELAMQAGYSTAPDNVRALGFGAGMGLPNMKKYSDEMSINTILGEGTTVSLKVYM

SEQ ID NO: 10326 - protein, 139 aa, Thermoanaerobacter sp. X514
MVLYSLDFDVKARDFDSAGEVSSNLRSVLKQLSLNPDVVRRSCIACYEAEMNIIIHSYGGHMKIEIFGDKIRITAEDTGPGIEDIELAMKEGYSTAPEEIREMGFGAGMGLPNMKENSDFMDIKSSKNGTTVVMEILFK

SEQ ID NO: 10327 - protein, 321 aa, Thermotoga RQ2; identical to SEQ ID NO: 10324

SEQ ID NO: 10328 - protein, 144 aa, Natranaerobius thermophilus JW NM WN LF
MDEEQEKFIKSYKLEGQDFQSGGEASAQIKQILKSLGVPSKIIRKATVISYEAEMNVIIHSYSGEIILDVDQYRVVIRTEDTGPGIQDIDKAMEEGYTTVSTEILEMGFGAGMGLPNIKKFSDNLKINSQVGEGTVLEATVYIN

SEQ ID NO: 10329 - protein, 290 aa, Dictyoglomus turgidum DSM 6724
MKIPKEYLEKIKVKDIMNTDIVRLRPYQDMRSIQEIMRIKRIDAIPIVDDLENLIGLVTVENVINALAKGDINVPCEKYMVRDPKCLKPDDNLYEALIKFRRFRFGRFPVVDEKGKVLGILSTKDIVLNLVDVEDIEGIKEEKKEEAVLILEYPVMGGDFALAGVASSNVKKVLQQLGIGPDIIRKVAVVTYEAEMNIVIHAYRGVLRVKVTPEYIDIVAEDEGPGIPDIELAMQPGYSTAPDNIREMGFGAGMGLPNIKNSSDELHIDSIVGRGTTVHSRIYLKRERNV

SEQ ID NO: 10330 - protein, 139 aa, Anaerocellum thermophilum DSM 6725
MLLELEFEIEPGNFILAGEASSKIKETLKKLGVKPEILKKVAIVSYEAEMNIVIHSIGGILKAVISKDKIEIVAQDDGPGIEDIELAMKEGYSTAPEEIRNLGFGAGMGLPNMKKYSDYFEIESQKGKGTRVYMVIYNK

SEQ ID NO: 10331 - protein, 142 aa, Desulfotomaculum acetoxidans DSM 771
MQLEFEIKGMDFARAGEAAAKIKKALQMVGMEVETIRKTLVVAYEAELNVVIHAYAGTLTAKISPDAVEIKVMDEGPGIADIELAMQEGYSTAPSNIREMGFGAGMGLPNIERCSDQMELTSEVNQGTLLTAIIFNRTSGEK

SEQ ID NO: 10332 - protein, 163 aa, Brucella suis 1330
MSDAAREKDGKAKGSMMGLLAAVAVLTAIAGGGGWYLGNMISAGQQASAKPSGKEDKPKPGSFESRSIGAVVPLQPIITNLGIPQTTWVRLEASLVAKPGHEIPPAMAANVSDDFMRFLRSVNLMQLQGAAGLAYLRTDLEERARLRSEGAVDRVFISALVVE

SEQ ID NO: 10333 - protein, 147 aa, Rhodopseudomonas palustris BisB18
MQWLVVFLVLTAVSAAAGVLSSLHVLSAVQHTADTQQKVEPPPAASAFSPSARLRKMAPVVTNMASPPGAWIRVEASVITDQVDDEQANVLIARVGEDVVSYLRTISPTQIEGARGLQYLREDLNERAAIRSSGKVRELIIETLVVQ

SEQ ID NO: 10334 - protein, 150 aa, Mesorhizobium BNC1
MQAAALLVMTALAGGMGWLTGAYLEERSASGQSENAGKTEVAVQEGQEGNEPDNESLSSIVALDPITTNLAEPTSIWVRMELALVFEGESDPTLARTIHQDLFAYIRTLRLKQIESASGFQHLKSDILERARIRSDDRVKQVLIMSFLYE

SEQ ID NO: 10335 - protein, 165 aa, Bartonella bacilliformis KC583
MDKEPKQEEATVNKDNSVKTLLIVGLILTLIAGAAGWFLSLWVSQEIRQTSGASKDSSIAIPASKIMADTHTVVLPPLVTNMASPEKAWIRVEIALIVKSGETISSTEVANISSDFLAFLRQITIDQVKGPSGLMHLRSDLFDRAKIRSGDKISNILISNLVIEQ

SEQ ID NO: 10336 - protein, 163 aa, Brucella ovis; identical to SEQ ID NO: 10332

SEQ ID NO: 10337 - protein, 163 aa, Sinorhizobium medicae WSM419
MEEIESKETKSPSRVMTIAAVAALTLVAGGGGWLAGMLLAPPAAEKTEAAVELPANATGEEEIARIATVANGIVQLDPITTNLAYPAENWVRLEVALQFNGVPDVALAETIHQDIAAYLKTVSLQQVQGPRGFQYLRDDIQERVDLRSEGRVTSVMFRTFVIQ

SEQ ID NO: 10338 - protein, 164 aa, Ochrobactrum anthropi ATCC 49188
MSDTTVTEKDGKAKGSLTGLLAAVAVLTVIAGGGGWYLGGMISADQLASAKPSGKEDKPKQGDFESRSIGTVVPLQPIITNLGIPQNTWVRLEASLVAKPGHEIPAAVAASVGDDFLSFLRSVNLMQLQGAAGLAYLRSDLEERARLRSEGAVERVFISALVVE

SEQ ID NO: 10339 - protein, 160 aa, Methylobacterium extorquens PA1
MADAKDSKKGGKGWIGALALVTLIAVGTGGGLGVYLLGTVEKSVDLKQREEAGKAVKVLNYTGDLSLRSVGSVVANLAEPTDSWVRIESSVVFNTGALPNPDVTLAEIRADALAYLRTLSLAQIEGANGLQHLREDLNERVATRTKGAVRELIVESLVVQ

SEQ ID NO: 10340 - protein, 160 aa, Methylobacterium radiotolerans JCM 2831
MASDTVTRRARLRWLLLLALLTVLAVGVGAASGLHMIARVEKALDERRKAQDEQVRPVTAYAENDTLTSLGTVVTNLAGPGDVWVRLESSVIVRPGTFANPQAMVAEIRQDIVGYLRTLSVAQIEGPSGLSHLREDLTERVQIRSNGQIRTFFIETLVVQ

SEQ ID NO: 10341 - protein, 167 aa, Beijerinckia indica ATCC 9039
MASQDVPALPSNPSLSQSKLHRLGVLVGLTLFAGAVGASVGYYLVLSIKAKLADTMSTIEKENSPSKLGANVNAWPLPPIIANLADPPNSWIRLETVMLFDSKIVPKPEVLSMQLTTDVLGYLKTLSVAQLAGPSGFQNLRDDLNERAHIRSNGAIQELVIQALVIQ

SEQ ID NO: 10342 - protein, 160 aa, Methylobacterium populi BJ001
MADAKDSKKGGKGWIGALALVTLVAVGTGGGLGVYLLGSVEKSVDLKKREEADKAVKVLNYTGELSLRSVGSVVANLAEPTDSWVRIESSVVFKTGTLPNPDVTLAEIRADALAYLRTLSMAQIEGASGLQHLREDLNERVAIRTKGAVRELIVESLVVQ

SEQ ID NO: 10343 - protein, 168 aa, Rhizobium leguminosarum bv  trifolii WSM2304
MAEPDASAGQPKKKSGTLMMIIGIAVLTLLGAGGGWAVGTIVAPNIKGAKEAEQAKDAEAKKKAEEGLAHISTEANNVVQLEPITSNLAYPSENWVRLEVALLFNGPPDVKVSEDIHQDILAYIRTVSLQQIEGPRGFQYLKDDIQERVDLRSQGRVSKVMFRTFVIE

SEQ ID NO: 10344 - protein, 168 aa, Methylocella silvestris BL2
MSTDEDYDLEAASTRPAGASLAAFAGLMAALTIVAMISGGALGARLGAVVKTQLAGAPGSARADAQSAYSGGVNLQDLPPIIANLAEPSDAWVRLQATLVLDRPASGKPDVLAAQIAEDILGFMRTATLSQIAGASGLQHLREDLNERAMIRSDGRVRELILQTLVVQ

SEQ ID NO: 10345 - protein, 160 aa, Methylobacterium chloromethanicum CM4
MADAKDSKKGGKGWIGALALVTLIAVGTGGGLGVYLLGTVEKSVDLKQREEAGKAVKALNYTGDLSLRSVGSVVANLAEPTDSWVRIESSVVFNTGALPNPDVTLAEIRADALAYLRTLSMAQIEGANGLQHLREDLNERVATRTKGAVRELIVESLVVQ

SEQ ID NO: 10346 - protein, 172 aa, Agrobacterium vitis S4
MADAPALEGPSKKASPILLIAALAGLTVVGAGAGWLVGTMVAPKVKVAKEEQKAAEEAGGKKKEGEKEETGLPKLPAEANGIVQLDPVTTNLAYPSESWVRLEVALVFNGPVDAKLAEDIHQDLMAYMRTVSLQQIEGPRGFDYLKDDLRERVDVRSEGRVSKLLFRTFVIE

SEQ ID NO: 10347 - protein, 168 aa, Rhizobium leguminosarum bv  trifolii WSM1325
MAEPDASAGQSQKKSGALMTIIGIAVLTLLGAGGGWAVGTIVAPNIKGAKEVEQAKDAEAKKKAEEGLARISTEANNVVQLEPITSNLAYPSENWVRLEVALLFNGPPDVKVSEDIHQDILAYIRTVSLQQIEGPRGFQYLKDDIQERVDLRSQGRVSKVMFRTFVIE

SEQ ID NO: 10348 - protein, 120 aa, Rhodoferax ferrireducens T118
MSLILAVDDSPSMRKMVSFTLTGAGYQVVEAVDGVDAYEKAQAQSFDLVLTDQNMPRLDGLGLTRKLRDHPQFKTVPILVLTTESSDLMKQAGRAAGATGWLVKPFDPARLLEVIKKVIK

SEQ ID NO: 10349 - protein, 120 aa, Acidovorax avenae citrulli AAC00-1
MQSILAVDDSPSMRKMVSFTLTGAGYHVVEAVDGQDALEKAETHDIQLVLADQNMPRLDGIGLTRKLREHPRFKTIPILILTTESSDQMKQAGRNAGATGWLVKPFDPNRLIEVIQKVIR

SEQ ID NO: 10350 - protein, 120 aa, Acidovorax sp. JS42
MQSILAVDDSPSMRKMVSFTLTGAGYHVVEAVDGQDALEKAETHDIHLVLADQNMPRLDGIGLTRKLREHPRFKSIPILILTTESSDQMKQAGRSAGATGWLVKPFDPTRLIEVIQKVIR

SEQ ID NO: 10351 - protein, 120 aa, Verminephrobacter eiseniae EF01-2
MPSILAVDDSPSMRKMVAFTLTGAGYHVVEAVDGQDALEKAETHRIDLVLADQNMPRLDGLGLTRKLRELPKFKTIPILILTTESSDQMKQAGRTAGATGWLVKPFDPHRLIEVIQKVIR

SEQ ID NO: 10352 - protein, 120 aa, Methylibium petroleiphilum PM1
MHSILAVDDSASMRQMVSFTLKSAGYDVTEAVDGQDAYDKAAQRQFDLVLTDQNMPQLDGIGLTKKLREHPSFKATPILILTTESSDQMKQAGRAAGATGWMVKPFDPAKLLEVIKKVIR

SEQ ID NO: 10353 - protein, 120 aa, Delftia acidovorans SPH-1
MRSILAVDDSPSMRKMVAFTLAGAGFRVVEAVDGVDALEKAQLEQVDLVLADQNMPRLDGIGLTRKLREDPKFQNTPILILTTESSDQMKQAGRAAGATGWLVKPFDPNRLIEVIQKVMR

SEQ ID NO: 10354 - protein, 120 aa, Leptothrix cholodnii SP 6
MHSILAVDDSASMRQMVSFTLKSAGYNVVEAVDGQDAWEKAGSRSFDLVLTDQNMPRLDGIGLTRKLRETSQFKNTPILILTTESSDQMKQAGRSAGATGWLVKPFDPTKLIEVIKKVVR

SEQ ID NO: 10355 - protein, 120 aa, Diaphorobacter TPSY uid29975; identical to SEQ ID NO: 10350

SEQ ID NO: 10356 - protein, 179 aa, Burkholderia mallei ATCC 23344
MSSEAMSTMQTTPACDGEPPAWYGKIPGAGDFVNHRLSHELAGWWERWLQQGMAAMRQRGDDELARYYTVAPVWNFLIPAGAGAQCVQPGCLAPSCDRVGRYYPVIATLPMRTADYWSALPDAADAFYWQVGSALLDAIRHARAPVQLEQALAKVRLVPGAAAGSAWFGVVRRRGGRAR

SEQ ID NO: 10357 - protein, 301 aa, Burkholderia pseudomallei 1710b
MQTTPACDGEPPAWYGKIPGAGDFVNHRLSHELAGWWERWLQQGMAAMRQRGDDELARYYTVAPVWNFLIPAGAGAQCVQPGCLAPSCDRVGRYYPVIATLPMRTADYWSALPDAADAFYWQVGSALLDAIRHARAPVQLERALAKVRLVPGAAAGSAWFGGAGGGPGERDWRGGARDAARESDAGWAIGGAGDIDGAGVRGAGDEGDGGDRGDRGEAGGMSGVGAADGGDARNGALAQPMPSPPATPAWPGLSQYFDPHGATSFWWTNRADGSPLRTHAHTGAPDSRLFLRLFGGVQHGV

SEQ ID NO: 10358 - protein, 231 aa, Burkholderia 383
MPSEAMSPTPPFTRTDGDAPAWYGKIPGAGDFVNSRLPHALALWWERWLQQGMAAMRQRGADEIERHYTVAPVWNFLIPAGAGASCIQPGCLAPSCDRVGRYYPVIVTLPMRAADYWNGLPDAADAFYWQVGQALLDAIRHARAPGDLEQMLERVRLTQGDDTYADIVEGMPAPPPERPAPAAWPGLSGYFDPHGGTSFWWTNRADGSPLRTHAHTGTPDNALFLTLFGGS

SEQ ID NO: 10359 - protein, 288 aa, Burkholderia thailandensis E264
MPTTLACDGEPPAWYGKIPGAGDFVNHRLSHELAGWWERWLQQGMAAMRQRGGDELARYYTVAPVWNFLIPAGAGAQCVQPGCLAPSCDRVGRYYPVIATLPMRTADYWSALPDVADAFYWQVGSALLDAIRHARAPVQLEQALAKVRLVRGADARSAAFGGAGGERGELGESGWRGERVAARESGEGGCIGGAGDIDGAGESGKSGASDERGESGGEARSGPFARPRPSPPATPAWPGLSQYFDPYGATSFWWTNRADGSPLRTHAHTGAPDSRLFLRLFGGVQHGV

SEQ ID NO: 10360 - protein, 478 aa, Jannaschia CCS1
MKDRGGTHIPHWRGYYGKVPVAGDFVSHGLPRSVENVLDDWLRRAIRDSQKRLGRDWLDAFLVTPVWRFALAAGLLGPQPVAGVMMPSVDRVGRYFPLMIAASRPDATGDILALSADGLFYDAAEALVLSRLDATVPFQALVDGLSALPFAHLPQIDPDPEDEAAALWWTGRDAAQTHATIGLPQHTDFSDIFLCKAPKSLAGHAPATPAPLRQPEAAEMQPDHRLTRRPMLVREAPAPDTSPLPQSPAEPTTATLLGVDHAFASLKGTRSAALTDAVSVSGDGQAFSLLSGIGQDAALPAQVSGLVPVLAEIAAPFSMNDLIAEAKGKLGRANTFLTARSATSGQTTAVATISVLVQARRYAVLWAGHCTAWLQRDGTLHPLNRPHVDARLRGTVTRALGVTRTITFDTAIGQAQAGDRFLLLSPGVTHALPPDEIARTLATADTPQMAVTQVTQNALIEGTPLDATALAIFLSPRS

SEQ ID NO: 10361 - protein, 258 aa, Saccharophagus degradans 2-40
MEAVGDFQTNSTANPAPQTDTCGLFGKLPQQGDFISHFLPAAFTDVWHAWLQGCLGVSKEQLGDTWLDFYLTSPVWRFSLMPTITHPQSVAGIMIPSVDEVGRYFPLTLVQIYNHTPWSAYLHGDAWFSQLESAALLALEEHTSYSNFIGNFEMLPSLQLPEFSNFETLHAQHSYAENFVVETPPSNSDQQLPLNLLHKAYQRIYGAYGIWWTQGSEHIAPTLLVNSGLPDAGQFAAMLDGNWQQWGWNLESVLENKN

SEQ ID NO: 10362 - protein, 163 aa, Rhodobacter sphaeroides 2 4 1
MASERAMAGFFGKLPSTGDFVTRGLSPAFRAAWDGWITRHVAGRLGAGPEGGLRVRLRSGGRVAGGVVLPGRDRIGRSFPLSLLLVADGLPGPDGLDPWCEAARAAAAVHPEPDALWQALSDIPVPEGDAAAAAPLLLWTGKASAACDPRDPAEALGRLLGTG

SEQ ID NO: 10363 - protein, 243 aa, Shewanella frigidimarina NCIMB 400
MSCEPLTSVGYCGKVPSKGDFIQQNLNVDFLKNWNDWLQAVIAVSKEQTEHNWLDYYLTSPIWHFSLSAGVCCDQAVVGTVIPSVDHVGRHYPFTLAGLHNQSALRGWKDNQWVEVFEQNILQVLEDDTVLSKWLDAITKETLTVAANNDKLLESESLDRNKKAWVFQGDNSPDVLLLLDQQYRKRFDRYSIWWTEGSDDVEPCTIITEGLPQISQFISMLNGQWQQRGWNTAELIKEQTSCT

SEQ ID NO: 10364 - protein, 226 aa, Pseudomonas aeruginosa UCBPP-PA14
MNSVGFYGKLAGRGDFVSRGLPNTFVEPWDAWLASGMRASQDELGAAWLDAYLTSPLWRFAIAPGLLGGEAVAGVVMPSIDRVGRYFPLTVACLLPANADLGGLVGGDDGWFEQVESLLLSTLEPEAEVEAFEQAVAQLPAPPCGPRIEQSLISGNLLRSEAVTPAQRLAALAQHACDGASHWWGRGSARISAGLMRYQGLPPAPAFGRFLTGEGEVIPLFPGIPG

SEQ ID NO: 10365 - protein, 171 aa, Paracoccus denitrificans PD1222
MPGSVLGPQAGFWGKLPARGDFVGRGLPEAFRRRWDRWAATHLAGREGWPGDWPHDWPDGGLRLRIASGGRAAAGLVLPSADAVGRRFPLALFLLDDTLPGPEALEPWCEAALQAAAEPDPDALWQALAALPTPIGKADAPPLLLWRRGHPALEADPAAPEPALAAIFSSG

SEQ ID NO: 10366 - protein, 237 aa, Acidovorax avenae citrulli AAC00-1
MSWQSLMPWSRAQPRVAWFGKLPGQGDFVGRRMPRAMSGAWDEWLSHGLGHLRSTAHGDWERTFTQAPLWSFVASGGKGAAPSCGVLAPSIDRVGRCYPLTVMAVGEGGRQSLAADGVLGQFFSEACDAVIEARRLALPADALDTRLSRLPWPFAATAPDGRGQGGDMAGILSDLGMGGTAGQGEAMFSRGRDILRAGQAASFWWSYPPGAGGRSCEHWGVPNESLFLRLFGGGPNA

SEQ ID NO: 10367 - protein, 174 aa, Burkholderia mallei SAVP1
MSTMQTTPACDGEPPAWYGKIPGAGDFVNHRLSHELAGWWERWLQQGMAAMRQRGDDELARYYTVAPVWNFLIPAGAGAQCVQPGCLAPSCDRVGRYYPVIATLPMRTADYWSALPDAADAFYWQVGSALLDAIRHARAPVQLEQALAKVRLVPGAAAGSAWFGVVRRRGGRAR

SEQ ID NO: 10368 - protein, 163 aa, Rhodobacter sphaeroides ATCC 17029
MASERAMAGFFGKLPSTGDFVTRGLSPAFRAAWDGWITRHVAGRLGAGPEGGLRVRLRSGGRVTGGVVLPGRDRIGRSFPLSLLLVADGLPGPEGLDPWCEAARAAAAAHPEPDALWQALSDIPVPEGDAAAAAPLLLWTGKACVACDPRDPAEALERLLGTG

SEQ ID NO: 10369 - protein, 301 aa, Burkholderia mallei NCTC 10247
MSTMQTTPACDGEPPAWYGKIPGAGDFVNHRLSHELAGWWERWLQQGMAAMRQRGDDELARYYTVAPVWNFLIPAGAGAQCVQPGCLAPSCDRVGRYYPVIATLPMRTADYWSALPDAADAFYWQVGSALLDAIRHARAPVQLEQALAKVRLVPGAAAGSAWFGGAGDGPGERDWRGGARDAARESDAGWAIGGAGDIDGAGVRGAGDEGDGGDRGEAGGMSSVGAADGGDARNGALAQPMPSPPATPAWPGLSQYFDPHGATSFWWTNRADGSPLRTHAHTGAPDSRLFLRLFGGVQHGV

SEQ ID NO: 10370 - protein, 328 aa, Burkholderia pseudomallei 668
MQTTPACDGEPPAWYGKIPGAGDFVNHRLSHELAGWWERWLQQGMAAMRQRGDDELARYYTVAPVWNFLIPAGAGAQCVQPGCLAPSCDRVGRYYPVIATLPMRTADYWSALPDAADAFYWQVGSALLDAIRHARAPVQLERALAKVRLVPGAAAGSAWFGGAGGGPGERDWRGGARDAARESDAGWAIGGAGDIDGAGVRGAGDEGDRGDRGDRGDRGDRGDRGDRGDRGDRGDRGDRGDRGEVGGMSGVGAADGGDARNGALAQPMPSPPATPAWPGLSQYFDPHGATSFWWTNRADGSPLRTHAHTGAPDSRLFLRLFGGVQHGV

SEQ ID NO: 10371 - protein, 327 aa, Burkholderia pseudomallei 1106a
MSSEAMSTMQTTPACDGEPPAWYGKIPGAGDFVNHRLSHELAGWWERWLQQGMAAMRQRGEDELARYYTVAPVWNFLIPAGAGAQCVQPGCLAPSCDRVGRYYPVIATLPMRTADYWSALPDAADAFYWQVGSALLDAIRHARAPVQLERALAKVRLVPGAAAGSAWFGGAGGGPGERDWRGGARDAARESDAGWAIGGAGDIDGAGVRGAGDEGNGGDRGDRGDRGDRGDRGDRGDRGDRGEAGGMSSVGAADGGDARNGALAQPMPSPPATPAWPGLSQYFDPHGATSFWWTNRADGSPLRTHAHTGAPDSRLFLRLFGGVQHGV

SEQ ID NO: 10372 - protein, 229 aa, Pseudomonas mendocina ymp
MTVGFYGKLASRGDFIHRGLPSAFIESWDAWLATGIATSQQELGPAWLDAYLVSPLWRFALAPGLVSSGAVTGVMMPSVDRVGRYFPLTIACLLDADADLGSLLGGPDAWYEQAEALLLSTLEEGSECEAFEAAVAALGDPPCSRRRPRTPGFRQMHFGVASPAERLAVLAQLTCEGASLWWGRGSEHVAAGLLCCAGMPAAQAFSGLLLGADVSPAPSLAAQLQSESR

SEQ ID NO: 10373 - protein, 176 aa, Acidiphilium cryptum JF-5
MARVSGFYGKIPARGDFVGAGLPRAVVDAFDGWMRASLEASRNALGDDWQACWMEAPVWRFAAPVAGVPLGGVWLPSIDRVGRAFPLVLATDAACAGSAWLDAVEEIGIAAVTADVPPDTFAARLADLPPDPCEPAYGWWSAGGPHRGPGRIEVAGLPDPAGFAAFLRDEAGETVR

SEQ ID NO: 10374 - protein, 226 aa, Pseudomonas aeruginosa PA7
MNSVGFYGKLAGRGDFVSRGLPNTFVEPWDAWLASGMRASQDELGAAWLDAYLTSPLWRFAIAPGLLGDDAVAGVVMPSIDRVGRYFPLTVACLLPANADLGALVGGDDGWFEQVEGLLLSTLEPEAEVEAFEQAVAQLPAPPCGPRIEQSLISGNLLRSEAATPAQRLAALAQHACDGASHWWGRGSARISAGLMRYQGLPPAPAFGRFLTGEGEVIPLFPGIPG

SEQ ID NO: 10375 - protein, 240 aa, Serratia proteamaculans 568
MMSNDLIPTTSIGWYGKIPSAGDFLQRRLPDMVVNNWAHWFHNGLVNLQRNPPGANGNPFSNAPVWNFVIPATLGSQYVQMGCLLPARDRVGRHYPICALRLFCQQDWRTQQLNMAAEWYNQLGHRLLNGVRNGFSAEQLDRSLLEIPALPTPPAEADSEILSIIGFQHPDVPGLGWQQAADCFDPAQYTSFWWTNQADGHPLYTHVHSGNLTVQLFSLLFEPNGWARPGRGGQYPQMFD

SEQ ID NO: 10376 - protein, 234 aa, Delftia acidovorans SPH-1
MSGPAVNAMTLQRPCAAWWGKLPSQGDFVGRRMPHALTMRWDEWLRNGMDQLRSDAADNWSTRFVHSPLWFFLCPASILGQPMVGVIGPSSDRIGRLFPLAIMATVDGSSGMPASDQDIERFLSGARDALIDARRLPLSAQQLDERLATLQWPFQQDGRTPGSASIHSLLADLDMGASQGNAARLPRMDWRACMRPGSTTSVWWISATPRHAPDEVVQHEVLHRRLFTRLFKGA

SEQ ID NO: 10377 - protein, 231 aa, Leptothrix cholodnii SP 6
MHEAPGWYGKLGALGDFASRRLPHAQVQALDHWLASVMSISQSELGGAWLDHYLRAPLWRYAWAPGVVDNQWWFGVLMPSCDSVGRYFPLLLAQPRAQAPQDRLALNHLELWWRHLAEAALATLAERATLDEFEQALAEAPPWPTPASANPPLARSSRNRITGRPCEEQPLGPRTDLADWLGHRAAQALLQQLGGHSLWWPFELGRSTPPIRLLQGLPDGAEFGALLGHAD

SEQ ID NO: 10378 - protein, 212 aa, Xanthomonas oryzae PXO99A
MQRPPGFYGKLPAVGDFVHRRLPETFVDPWHVAMQGVLSANAATIATPAQHAPVWRFVLMPGLAGTAAWVGAMRASVDRVGRAFPLVIAAALPARDADGATAAATPTHLRLPAWLDAANTVLCTIGAKRQQDGAWLDHACVALAQHAHDDASVLAPPLADATTAGSSLWWTAMTASAPGAWMRLAGWPAAGHAPILLGPSHAPSACLAEAVQ

SEQ ID NO: 10379 - protein, 233 aa, Methylocella silvestris BL2
MMRCGLIGKIAAKPDYVALDAPAPLLAAMEPWLHASIASSRLMLGESWQGVFRAAPIWRFWLGAEIAGAPVLGALAPSIDAGGRYFPLIAFASSEAAIAILPPEFADHDAWFKAAEALLLASLGQGASYEATVAAVERLPAPACAPAVAIRPPLAALAGGVTAPLDDKPLAEVFSWLRRADWGKSYGARSFWWTAGGVSFRPRALGFYHLPDPSLFAAMLTGEFSGGSGAGMG

SEQ ID NO: 10380 - protein, 222 aa, Methylobacterium nodulans ORS 2060
MRLGLYGKLPMKRDFVAHDVPRTVLAAVEPWLQGGLAASRARLAEGWREAYLRAPLWRFWLGADICGAPVLGVLMPSVDGIGRYFPLALFAIADRGEALPPPEVDAHAPWCAAAEALLLSALDERATFEALTARLATLPFLGAEPPPEDAPDALALPLALGFPAILDQARRADPARHAAALAVFWTQGGEGFAPRAVVAHRMPRPDLFASLLTGEFPGGAPC

SEQ ID NO: 10381 - protein, 483 aa, Agrobacterium vitis S4
MALRPAQTEKPANQDRIGFFGKLPSHGDFLSDGLEREMVATLDGWIRGGLHACEQEFGSAWPELFSASPPWRFIVEKGVWGQVAHAGVMLASRDRVGRSFPLIIMAQMHRFTHHPRTLFLDHTWFMAAEGLAESTMTREFDINRFTETLKRMRMPRPQEEEGTATASKDGTALWWYIDPQTSKPQGLRFSSQMKAEDFLRLFRQSAGLTSRPQDTTAPASSRAPGPVPIKAEARPAPQRTAPSPDKPPRDQQAPEPQAAGLRYSYATHAGTRFSINADGLFICEKPRIFAIADGVGDDTASQEAARYTAGQLAEIGETADLDTILQEIKGKLGRANSLLQARTQRTDGTAPAASVVVAALVNHQLLLVWAGDARAYLLRDGTMVPLTRDHIAIGLQKRLRRGVGLDQQFLPETLTTDILPGDRLLLCSFPLIQVLTERTVAEILHQCTDTESAERLVQEALIANVRENVSAIVVSLARSDASA

SEQ ID NO: 10382 - protein, 232 aa, Azotobacter vinelandii DJ
MSMVAPIFQAETAVGWYGKIPAAGDFVMRQLPYPLLRAWERWMQSGLNALRQQGAQMLSQHYAVAPAWNFLLPAGLGCDAVQLGCLAPSHDRVGRHYPLAAILGVPPAEFDNALLEGAAPFYRQVGEAILGAVRQGLSVEQLSDRLAAVPGDWRGRPPRGGAGDILAVLEPGAGDQGLAWPELSLSFDARGATGFWWTHQGDGAPLQTHTHNGEPDDALFARLFGPQRGDVS

SEQ ID NO: 10383 - protein, 241 aa, Variovorax paradoxus S110
MNSGIPSPRVWVPDDEQIGWYGKLPAAGDFLYRRVPRELQAWWDRWMQNGLGTFKRWPDAMTRHYVVAPVWNFAIPATQGVDAVQFGCLAPSCDRVGRYYPVCVTLQVAASSYRPSMLEGSAAWYWQCGTALLQAIRHSVAPDQFDRQVLAAAHGGFQTASGGSDDILSILGPAAGGAGATGAQQRLGWPELPLCFDAFGSTSYWWTNQADGSPLRTAAHGGGLNTPLFSKLFSQGHVPWA

SEQ ID NO: 10384 - protein, 208 aa, Variovorax paradoxus S110
MSDDAAVFSALPGWFGKLPGMGDFAHRRLPESFRSVWDPWLQRGLARLRDRHADWTSHYLEAPVWCFALGPQVVGEGAWIGVLMPSVDGVGRYFPFTLAVGLDASAGGALQGDALQDALRWWARGTRAALEGLEGDLDALRFDAVLERVFAAAGDLEVREMAVESLALPGVGESLWLGDPGAGDGARMLVAGLPLDGRFEALFLGGGE

SEQ ID NO: 10385 - protein, 183 aa, Colwellia psychrerythraea 34H
MSTVTQEKITQEKLSDQERQYILLTQNGLPIIQEPYHAIAEQMNLSVEQVLSLTKSMQERGIIRRIAAVPNHYKLGYQFNGMTVWDIDDEQAEKFGDAVGRLPFVSHCYLRPRFLPDWNYNLFAMVHGKTEESIAKYRGQIKELLKEVLVTRNHDSSQDIITKSNDMLTSTAILKKTGLRLKK

SEQ ID NO: 10386 - protein, 166 aa, Ralstonia eutropha JMP134
MEPYAHDVIDLALIRATQGGLPLVSSPYAAVGTQLGIDEAEVIARLTAMQANGTLRRIAAVPNHYALGWRANGMTVWDVDDACIDALGEQVGALPFVSHCYRRPRNLPLWPYNLFAMAHARTREEALPLVARIAQLLGDACRAHDVLWSTRILKKTGLRLPPARTE

SEQ ID NO: 10387 - protein, 166 aa, Thiobacillus denitrificans ATCC 25259
MNARDDFRPLDDTDRRIIQATQAGLPLTPRPYHAVAEQLGLPAAEVMQRMQRMLDLGVIRRIGAVPNHYALGYRANGMTVWDVADERIDELGERIGQLDFVTHCYRRPRHLPDWPYNLFAMVHGRTREEVEAKAALIADALGTASRARDILYSTRILKKTGLRIGA

SEQ ID NO: 10388 - protein, 171 aa, Pseudomonas aeruginosa UCBPP-PA14
MSACISPSDALLARRLIELTQAGLPLVADPWAWIAAQLRLSEAETLALLKRLRDAGVIRRIAAVPNHYRLGYRHNGMTVWDVADERIERLGRLVGGLSFVSHCYRRPRHLPQWRYNLFAMVHGRSEAEIEGYRQQIRLLLGEDCRADEMLVSSRILKKTGLRLAQKEERPC

SEQ ID NO: 10389 - protein, 160 aa, Paracoccus denitrificans PD1222
MTAPDDTDRRLIAATQAGLPLVEAPYARIAADLGVSETQVIARLSALNAQGVIRRIAIAPNHYALGMTANGMSVWDVDDAQAEALGEKVGALDFVTHCYLRPRAPVWRYNLFAMLHGQSRAEVEEKRAQVRALLGPACRADDILYSTRILKKTGLRLKDG

SEQ ID NO: 10390 - protein, 160 aa, Acidovorax sp. JS42
MALDAFDRALIAATQGGLPLVARPYEAVGAMLGVPGEQVRERLARMIDEGLVRRIGAVPNHYRLGYTANGMSVWDVDDTQVAALGRQVAALPGVSHCYRRPRHLPHWPYNLFAMLHGPSRAHVEQQAEQIAGLLGDACRAHDILYSTAILKKTGLRLKED

SEQ ID NO: 10391 - protein, 173 aa, Marinobacter aquaeolei VT8
MSTFTSKSDSVLSARDRELIVATQSGLPLVSDPWAELGKQLDMPADEVLTRFQRMQATGVIRRVAAVPDHYRLGFRFNGMTVWDVSDDAIAELGEKIGCLPFVSHCYQRPRHLPYWSYNLFAMVHGVSRDEVEHKAAQIREVLGDACTGHTILYSSAILKKTGLRLKKQTAKQ

SEQ ID NO: 10392 - protein, 164 aa, Methanoculleus marisnigri JR1
MDRVDKELLILTQDGIGFEERPFLRAARRLRISEEEVVARLQRLRQIGVVRRFGMRINPRKAELMANAMVVWSVPENCVAEVGAAMAESPDVTHCYERRTIPGRWEYNLYTVLHCRDREDALRRVAALSRATGAADYRVLFSTEEFKREPSGRIEPAAGPGRGR

SEQ ID NO: 10393 - protein, 171 aa, Pseudomonas aeruginosa PA7
MSACISPSDALLARRLVELTQAGLPLVADPWAWIAAQLQLSETETLALLRRLRDAGVIRRIAAVPNHYRLGYRHNGMTVWDVADERIERLGRLVGGLSFVSHCYRRPRRLPQWRYNLFAMVHGRSEAQIEGYRQQIRLLLGEDCRADEMLVSSRILKKTGLRLAQKEERPC

SEQ ID NO: 10394 - protein, 162 aa, Candidatus Methanoregula boonei 6A8
MMDPIDIQILAALEDGLPLVPEPFAEIGKRLGLSAEEVLARTQKLHAAGVIRRFRARINQRKLGISANALVAWRCDKKPAEKTGAILASFPSVTHCYERRPVPGRWEYSLYTVHHGRSREAVEDEIRKLAGAAGLSDYLVLFSTEEFKRVPHVRINGNGRGS

SEQ ID NO: 10395 - protein, 161 aa, Dinoroseobacter shibae DFL 12
MKMDHIDRALIAETQAGLPLVAEPYAAVAEALGMPEDQVMARLRSLKARGIMRRIAIAPNHYKLGMTANGMTVWDVRDADVAELGARIGALGFVSHCYERPRALPDWPYNLFAMVHGDTRDEVEAKRAEIATLLGAACRASDVLYSKRILKKTGLRLAKGK

SEQ ID NO: 10396 - protein, 160 aa, Leptothrix cholodnii SP 6
MPLDDFDRDLIAATQGGLPLVARPYEAVGAMLGVSGEQVRERLAQMLASGLIRRIGAVPNHYKLGFTANGMSVWDVDDAVVDQLGERIGALAGVSHCYRRPRHRPAWPYNLFAMLHGRSRHEVEQQAAQIATLLGAACRGHDILYSTAILKKTGLRLTET

SEQ ID NO: 10397 - protein, 189 aa, Thauera sp. MZ1T
MVQGMSGNGALARADAQDAAGAGMDEAALAEFDRRLVLATQGGLPLVPRPYAALAETLGVAEGRVRERLAAMLADGRIRRIGAVPNHYAIGYTANGMSVWDIDAAVIDAVGERVGALDFVTHCYRRPRHLPDWPYNLFAMVHAASHEAALARVEEIAALIAAEFPGACRNRDVLFSSGILKKTGLRIGA

SEQ ID NO: 10398 - protein, 160 aa, Diaphorobacter TPSY uid29975
MALDAFDRALIAATQGGLPLVARPYEAVGAMLGVPGEQVRERLARMIDEGLVRRIGAVPNHYRLGYTANGMSVWDVDDTQVAALGRQVAALPGVSHCYRRPRHLPHWPYNLFAMLHGPNRAHVEQQAEQIAGLLGDACRAHDILYSTAILKKTGLRLKED

SEQ ID NO: 10399 - protein, 162 aa, Candidatus Methanosphaerula palustris E1 9c
MDQIDVCLLRELERGLPLVPAPFEEIGKRLNLSGAEVVERIRLLKEAGIIRKFRARIDQRKVGISANALVAWKLSGSCDEDRGKLLATFPFVTHCYERRPVPGRWEYTHYTVHHGYSRDKVHNEIRTIAEQIGSPDYRVLFSTREFKRMPNVRIWEDGGSLP

SEQ ID NO: 10400 - protein, 144 aa, Jannaschia CCS1
MPEVEIEIGTRIFSVACQEGEEPFLRSAAKMLDTEAAVVLGQIGRMPPERMLLMAGLMLADKTAALEDDLRELQDKIATQDRALHTAEERLADRGRKIAELQDAGPAGGVPVPEDLSEGLAALAAKAEAMAEMLDPPSGSASGG

SEQ ID NO: 10401 - protein, 181 aa, Ruegeria sp. TM1040
MPEVTIHIGGRDFEVSCQEGEESFLHMAAGMLDDEAQVLSDQIGRMPEARMLLMAGLMLADKTAAVEDRIKEVEAKLAEKDALLEERDAELEELRNAPPPPAEQIEVPVVPPQVAETLAELAARAEALAGEIEEKAAPDDDEDDDEAATTPAVDPSADAMAAEGNADEAREETPDDVKEQV

SEQ ID NO: 10402 - protein, 124 aa, Rhodobacter sphaeroides 2 4 1
MPELSITIGGKSFEVACQPGEEEFLHSAAAMLDAEAMPVVEQMGRMTDSRMLLMAGLMLADRMAGADEELRRLRAQLAELEARPAPEPERIEVPVIPAGVKEALAELAARAEAMAERVEERARA

SEQ ID NO: 10403 - protein, 120 aa, Paracoccus denitrificans PD1222
MAEVDFSIGHKAYTLACQEGEERLLKRAAGLLDAEAQVILEQAGRMPEPRLLLLSGLMLADRTSGLEDRVATLERELARLKSNPQRVEVPVVPESLSEAMAELAARAEALAQKAEDQSAD

SEQ ID NO: 10404 - protein, 124 aa, Rhodobacter sphaeroides ATCC 17029; identical to SEQ ID NO: 10402

SEQ ID NO: 10405 - protein, 124 aa, Rhodobacter sphaeroides ATCC 17025
MPELSIAIGGKTFEVACQPGEEEFLHAAAAMLDAEAAPVVEQMGRMTDSRMLLMAGLMLADRMAGVDEEIRRLREQVAELEARPAPEPERIEVPVIPEGVKEALAELAARAEAMAERVEERARA

SEQ ID NO: 10406 - protein, 134 aa, Dinoroseobacter shibae DFL 12
MPELTITIGPRDFTVACQAGEESYLEAAAAMLDAETRVLSEQAGRMPEARMLLMAGLMLADKTAAVEDKLREAEAKLAELGQELEALRNAPAPAPERIEVPMIPPSVAEGMAELAARAESVADAVEAKARAGAA

SEQ ID NO: 10407 - protein, 362 aa, Thermobifida fusca YX
MLHGAPPRLSTGAQSTARRPETIPHAGAMSVLLRVLVPTVLLPLAVAAVPARHAAADTGPWTWPLSGTPVVLRAFDPPAQRWLAGHRGVDLAAEPGDPVLAAGAGRVGFAGTVGGVPVVTVVHGTLRTTYLPVAPLVRKGEEVHAGQPIGHLAEHPRHCAPRPCLHWGLLLGRDYMDPLSLLGEAAVRLLPLTGDLSRPRMGLLVDAGQPPDRDVRVDLGARQRRMAEDLLHAAQVSTPVEQMGGGAVPQPVRTGARHRRGGGVDVAAGGALPQPAAAGPQKKGATAVRGRPLGAAVPQPPVDSVERGNPDGHHSFPAAFAEHPQGVPFPVHVVKVQPAQFRNPDRSAVEDFHHGAAAQHER

SEQ ID NO: 10408 - protein, 291 aa, Frankia CcI3
MTPPAAGPLGGGEGDEHPDPPPGDVGPENSAAPPAHGGGVRALRWPLSGAVTVSRGFKRPPSPYGPGHRGVDLKASPAAPVLAAADGVVSFAGSVANRGIVTVTHGDLRTTYEPLTPAISPGTAVRAGDLLGWMSDGHPGCPVAACLHWGLLRGIDYLDPLLFFRRTPPRLLPLLPADRSPGSPGLVSGSGVSLLEGRAQPFRCHMGVDLRGRETRMAEKFLDGAQIGPAFQHVRRRRMPQTMRSQAGRSDTGRHPRRQNPPYRARIEATSAQAEEQRTPATSGHQPRPSR

SEQ ID NO: 10409 - protein, 211 aa, Nocardioides JS614
MASRPTARHVVPTLLLGLVLVLLAAPPASAGETDPVGVWPLLPAPSVVAGLDPPDDPWGAGHRGVDLLGSPGQPVRAALPGRVTWAGPLAGRGVVVVDHGATRTTYEPVDASVGVGATIAAGDRIGRLSAVGSHCPPRACLHWGWIRGDTYLDPLRLVGAGPVRLLPLWRDEPVGRGAVASPWRPPSLVYAGWVAPMALWARPQALGCACW

SEQ ID NO: 10410 - protein, 162 aa, Mycobacterium vanbaalenii PYR-1
MRILASAIAVAVVAAAPAAADDVRLGWPLKPSPTVVRQFDAPAPNWQRGHRGVDLAGADGQPVYAAAAGTVVFAGDLAGRPLVSIAHPGGLRTTYEPVRPAVRRGQQVTAGTALGELATGHPNCAAPACLHWGAMWGPASRADYVDPLGLLGTTAIRLKPLR

SEQ ID NO: 10411 - protein, 162 aa, Mycobacterium gilvum PYR-GCK
MRVLVLVATLVAICTAPAEADDGRLEWPMRPRPAVVRAFDAPAPNWQRGHRGVDLGGAEGQVIQAAASGTVVFAGELAGRPLISVAHPGGLRTTYEPVSPVVRRGQVVSTGTALGHLVAGHPGCAAAACLHWGAMWGPSSRADYVDPTGLVVTVTVRLKPLR

SEQ ID NO: 10412 - protein, 269 aa, Frankia EAN1pec
MPHPPRFDPHWLVIPALALMIALGCPGRVPIRGSFGAGAPDVLTAPATPAPPVTAAIPAAPTSPDATTSRSPADTPATTVAIPRTASSEPTAAPAVTDSPGGLTAAAPTEPTPGAPTSSPAQAPAQAPVPDGDQRWHWPLPEPVTVAGIFRAPAHPYGPGHRGVDLRSDPGVGVRAARPGVVGFAGWVGDRWVVTVVHGALRTTYEPVRPLVHEGQPVGGGDQLGLLEAGHPGCPGAACLHWGVLRGSEYLDPLSFFHRVPPRLLPLDG

SEQ ID NO: 10413 - protein, 191 aa, Beutenbergia cavernae DSM 12333
MPTTNAARLATALLALGALAAGIGAHVRADADPPPATDAARGRSAPVPLEGAPGSIYDWPLGGPPPDVVRRFEPPPAPWAAGHRGVDLAAAQGTAVLAASDGVVAFAGTVADRGVVSVDHADGIRTTYEPLAPTVPAGERVARGDVVGILQSGHAEVPCLHWGARRGSDDYLDPLTLVGEPPVIRLYPSSG

SEQ ID NO: 10414 - protein, 238 aa, Brachybacterium faecium DSM 4810
MSAPSVPCPSVRSLPALLMCCMALAALLALPASAHAGEARWQWPVPAPHPVLRAFEEPEHPYGPGHRGIDIGVTGEGAQVRAVEAGTVRFSGTVAGRGVVSVTHADGLLSTYEPVSGTVEVGTAVLAGEVLGTLEQRSELAHCAEETCLHLGARRGKDYLDPQLLLGLRGPSVLLPWDGPGERAPRTGAARPGPSAPGEAVRAPAPGAAAGSAAPEASALPRSHPMRPGRGALIALVG

SEQ ID NO: 10415 - protein, 271 aa, Kytococcus sedentarius DSM 20547
MGHGRVMAPLEHPLLTRSRALRRLGAAMTAAILLVTGTPDPVPASDPTPATEPRVSGTDPHVDAGASTQLPPPAWLPWQHRVQLDVVTRHAAHTWGLAAAVGQAPGSPAAPGTADGAAPRGSMPSSSTAALNPLDYKWPMWPVKLRRAFNPPKKAWGRGHRGVDLEGVPGQPVFAAGPGFISWSGTINSVGSLSVTHTPRLRTTYLPLTGRLPMGTPVIAGTPVGLLAPGHCLPACLHWGAKVSARKYVDPTLLPDFAPELKPRDERRRRR

SEQ ID NO: 10416 - protein, 170 aa, Nakamurella multipartita DSM 44233
MGGLRLFALVVLLAGVGPAPPAVPVPAAVPAATGFVLPIPGPPLVLTAFAPPPTRYGAGHRGVDLGAAAGVVVAAAGAGRVVFAGELAGRGVISVEHEGGLRTTYEPVTASVAAGSPVAAGQPIGTLQAGHPGCAPASCLHWGARLPDGTYLDPLALLRPWAVRLWPWDG

SEQ ID NO: 10417 - protein, 124 aa, Streptococcus agalactiae 2603
MSDIGIIVVSHSKNIAQGVVDLISEVAKDVSITYVGGTEDGEIGTSFDQVQQIVEQNDKKTLLAFFDLGSAKMNLELVADFSEKNIIINSVPVVEGAYTAAALLQAGADLDSIQSQLAELTINK

SEQ ID NO: 10418 - protein, 124 aa, Listeria monocytogenes 4b F2365
MAKPYGVVIISHSKDVAKGVHDIIKEIAPDVSITHAGGTEDGRIGTSFDAVNEAIESNEANKVYTFYDLGSAKMNIETVEEISEKEIILFNAPILEGAYATAAQVQMDEKPEVIAANLKTIEIK

SEQ ID NO: 10419 - protein, 120 aa, Staphylococcus aureus COL
MPKIILVSHSKEIASGTKSLLKQMAGDVDIIPIGGLPDGSIGTSFDIIQEVLTKLEDDALCFYDIGSSEMNVDMAIEMYDGNHRVLKVDAPIVEGSFIAAVKLSIGGSIDDALAEIKQSF

SEQ ID NO: 10420 - protein, 124 aa, Staphylococcus epidermidis RP62A
MTSIVVVSHSHKIAEGVKQLINQMTDGGVDLIAVGGLSDDEIGTSFDQIVSVINGLENDALCFYDIGSAGMNLDTALEMYEGDHKIVKMEAPIVEGSFIASVGIKSNMSMDSVISEVRAKYPEE

SEQ ID NO: 10421 - protein, 129 aa, Mycoplasma capricolum ATCC 27343
MVGIVVISHSSKIAQGAVELAKQMANNVKIIPAGGTKDNNIGTDIDLVLKAIYQAFDQNDGAIILFDLGSALMNAQMAVELLEPEIQQKVEIIDAALVEGTILAAINSSMNKSIKEIKQELINLKLNKI

SEQ ID NO: 10422 - protein, 131 aa, Rubrobacter xylanophilus DSM 9941
MVGLVLVSHSEKVARGTAEMVVQMAGEVEAIPVGGDPEGGLGTNPDRIREALESARSDELLVFMDVGSAVLAVESVVEGLAEELRSRVRLVDAPFVEGAFAAGVLASTGAGAGECVEAALEARTEPKLHGG

SEQ ID NO: 10423 - protein, 120 aa, Staphylococcus aureus JH9; identical to SEQ ID NO: 10419

SEQ ID NO: 10424 - protein, 120 aa, Staphylococcus aureus JH1; identical to SEQ ID NO: 10419

SEQ ID NO: 10425 - protein, 130 aa, Thermoanaerobacter sp. X514
MVGIVLVSHSRKIVEGIYELASQMTGGKVPIGIAGGTQDGRLGTDATEIMEEIKKVDEGEGVVVLVDIGGAVMSAQMAIELLGEEYEGKVKIADAPLVEGAIAASVEASIGSDFDKVLLVAEEAKKLNKF

SEQ ID NO: 10426 - protein, 126 aa, Halorubrum lacusprofundi ATCC 49239
MVGLVVVSHSERAAEGIVEVAAEMAGTTRIEPVGGDGRGGIGTVPDAIEDAIDAADDGEGVVVLVDLGSAVMNADVAVEMSDAEAVIADAPVLEGAVNAAVAATDPSATLDSVREQAEAARGMKKL

SEQ ID NO: 10427 - protein, 127 aa, Acidimicrobium ferrooxidans DSM 10331
MLVVSHSRRLAQGACELVGAMAKGVRLEWRGGEPPELGVSVELVADALEGLLEGGGEVVVVADLGSSVLAAEAAVELIGAGPRVRVLRGVPMLEGFIAAAMALTVGGGLAEAVAAAEAACGALEGGR

SEQ ID NO: 10428 - protein, 246 aa, Actinosynnema mirum DSM 43827
MVVSHSRKLAEGVVELAGQMAPEVRLVAVGGDGGGGLGTDYAAVVEGLADADGGGGVVVLFDLGSARMVADLAVEEFGGAAAVVDAPLVTGAVAAAVAAQGGAALEAVVAAALWAWGSGERAGGGAAGDGADGGADGGAGAGAGAGAGPGGAGGAAGDGVVRAVVPLVNDVGLHARPAGLVARALAGVDARVVVRHGGREVDARSVLELMGLGATGGDSVEVVAVGVDAEEAVRRVTELAARGFDG

SEQ ID NO: 10429 - protein, 131 aa, Geobacillus WCH70
MKHVSLVLISHSEEIVSGLKKLLNQVQPDVNIAVAGGNDGEIGTNAFRIKEAIESVYSEKGVVILFDLGSALMNAELAIEMLEKTDHIVIADAPLVEGAYIAAVEAGLGKSLDEIVRACEQAKQMVKVARS

SEQ ID NO: 10430 - protein, 132 aa, Rhizobium leguminosarum bv  trifolii WSM1325
MNGKTANVGIVIVSHSPLVARGIADMVRQMVGDSVPLAWSGGNVHGELGTDAGGILRAIEAAWSDAGVAVFVDLGGAETNSEMAIEMLGLPRAALVSICNAPLVEGAVIAAAEASGGASLAKVVATAEELSP

SEQ ID NO: 10431 - protein, 130 aa, Chloroflexus aggregans DSM 9485
MIGLLIVSHSARLAEGVQEFVAQISGGQFPVMAAGGASDGSLGTSVERILAALDQLRTTDGILVLVDLGSAVMSVETALEQFTGPPVQISNAPLVEGAYLAAVEASNTVTTLEQVAAAALQARELIKVYE

SEQ ID NO: 10432 - protein, 128 aa, Anaerococcus prevotii DSM 20548
MINILIASHSKDLAKGLSDIIGQMTTDVRIEYSGGDDEGNLGSNFEEIFAKMNELAPEGLVVFFDMGSSMMNVETAYSMLDEDLKEKVLIAGSPLVESALEISLSINEETSLDDIKEKISSYKFNKLD

SEQ ID NO: 10433 - protein, 140 aa, Nakamurella multipartita DSM 44233
MTVGIVLVSHSAQLAAGLAEVAAQMAPNVAICPAGGLEDGAIGTSFDLIAAAIERADTGDGAILLYDLGSGYLTAETAVEFLEDEQRARVVIVDAPFVLAAVSASIAANVGSDLRGVVDAALQARTANGPGGVRSVDELV

SEQ ID NO: 10434 - protein, 144 aa, Ralstonia solanacearum
MVGPDSYLTLHYRIALENDTDIVTTFGDKPATLLLGQGQLAPTLEQALLGMHEGERMTFRLAPEHAFGPRNPDLLQRVSLATLRENSSFEEDYQPGDLVEFNAPSGGKYAGVLKEVGETAALFDFNHPLAGQTILFEVQLIGIL

SEQ ID NO: 10435 - protein, 125 aa, Acidovorax sp. JS42
MINTFEDKPATLSVGTGELSPALEQRLIDLPEGARATFELAAGEAFGERNPDMQQWVAKKLLNELGDPHEEYTVGDVVQFPTPDGTGQYAGVVLEVREDGAVRFDFNHPLAGVPVTFEVLLIGVL

SEQ ID NO: 10436 - protein, 165 aa, Polaromonas naphthalenivorans CJ2
MPTLQSSIQSAQPDAVPVVEPGSFLTLHYRMAAPGGASIINTFDSKPATLSLGNGELSPAIEQRLLGLPEGTRTTFQLAAGEAFGERNPELVQWVARKLLNQLGDPDERYSVGDVVQFPTPDGMGQYAGAVQQIKDGDDAAVQFDFNHPLAGQPVEFEVHVIGVL

SEQ ID NO: 10437 - protein, 154 aa, Verminephrobacter eiseniae EF01-2
MTAIDIPPSTVQPGSFLTLHYRLAGPAGDVINTFADKPATLSLGQGQLAPAVEQRLLGLAEGTRATFELAAGEAFGARNGAMQQWVSRKLLDELGAPGAHYGVGDMVQFPTPDGQGHYAGAVLQVRDDGAVRFDFNHPLAGQPVTFEVHLIGVL

SEQ ID NO: 10438 - protein, 153 aa, Methylibium petroleiphilum PM1
MVNAQQVQPGSFLTLHYRLTGPDGADLINTFSDKPATLSLGTGELAPAVERRLIGLAEGAHTTFQLAPGEAFGERNLELLQRVALSVLRAHGDPDERYGVGDVVQFPTPDGQGAFAGVLRQLGPPEEDWALFDFNHPLAGQPLSFEVQLIGVL

SEQ ID NO: 10439 - protein, 148 aa, Polynucleobacter necessarius asymbioticus QLW P1DMWA 1
MTKLTVLPNSFLTLNYRLTLPSGEDYINTFIDRPATVLMGSGQFAPCFEKVLLGLSVGEKKSELLEPGESFGDRKEDLVQWVSLKALKEGRDDDAEFNPGDVIEFNAPGGAQYAGVLQSIDDEGAWFDFNHPLAGRAVTFEAEIVAIL

SEQ ID NO: 10440 - protein, 156 aa, Delftia acidovorans SPH-1
MTSSASSSALPTVQTGSFLTLHYRLSGPAGDVINTFNDKPATLSLGAGELSPAVEQRLLGLAEGTRTTFEMPAGEAFGERNGDMMQWVARKLMNELGDPHEQYAPGDVVQFPTPDGLGSYAGAVVQVREDGAVLFDFNHPLAGQPVTFEVQIIGVL

SEQ ID NO: 10441 - protein, 150 aa, Leptothrix cholodnii SP 6
MPQVQPGSFLTLHYRLSGPDGADIVNTFADKPATLSLGTGELAPAIEAQLLGLEEGTRSTFTLAAGEAFGPRSPQMMQRVKLALLREFGDPDEQYHVGDVVQFPTPDGQGSYAGVLRELGPIEEDWALFDFNHPLAGQPVTFEVQLIGVL

SEQ ID NO: 10442 - protein, 158 aa, Diaphorobacter TPSY uid29975
MTADAFASSSSVPTVQQGSFLTLHYRLAGPAGDVINTFEDKPATLSVGTGELSPALEQRLIDLPEGARATFELAAGEAFGERNPDMQQWVAKKLLNELGDPHEEYTVGDVVQFPTPDGTGQYAGVVLEVREDGAVRFDFNHPLAGVPVTFEVLLIGVL

SEQ ID NO: 10443 - protein, 147 aa, Variovorax paradoxus S110
MSHVVTSGSFLTLHYRLAGPAGDIINTFADKPATLSLGTGELSPAMEQRLMGLEEGTHATFELPAGEAFGERNPEMQQWVARKLLAQMGDPDEQYAVGDVVQFPTPDGAGSYAGAVVESNETAVRFDFNHPLAGQPVTFEVRLIGVL

SEQ ID NO: 10444 - protein, 177 aa, Chlorobium luteolum DSM 273
MSRIKAKRVGFRLDMTPMVDVAFLLLTFFMLTTKFRPPEPVVIDLPSSHSEKKLPESEVLTVTVSGDDDFFMGVSSQSTRERLFNAVILPKLEATGMSPAAVADSLKSFRLAETFPVERSELDRFVVMARFADQRLRPVVRADGGAGFEAVDHVIKVYKKANLLTFNLVTVLEKESR

SEQ ID NO: 10445 - protein, 177 aa, Chlorobium chlorochromatii CaD3
MARHKSQRKGIRLDMTPMVDVAFLLLTFFMLAARFRPPETLSVTPPASHSTQSLPDADLLTITVSRNHALYLSLSSKRDREALFNRTIRPRLQARSVSHSAIADSLRHFRISEQMPLQANELGQLIAHAKAANPELQAVIRADGEAALAPVNEIMQAFRRAGITTFHLVTMPSKEAR

SEQ ID NO: 10446 - protein, 201 aa, Cytophaga hutchinsonii ATCC 33406
MSKVKTKRHSISLDMTAMCDMAFLLLTFFILTAKMKVPEPAQFDVPSSVSTQKYEEKDLIRISISNDDRIFLTIPDQTLRREMIDAYANTFKVNLTPKQKEAFELTETFGMQKADLVSYLAQSTEIRKNFPQTGIPADSTNNELEQWIATATGVRPELTIAIKGDKDANYNKFGEVIATLKKRRIYAFSLVTTLEAKPANL

SEQ ID NO: 10447 - protein, 177 aa, Chlorobium phaeobacteroides DSM 266
MSRIKAKRVGFRIDMTPMVDVAFLLLTFFMLTTKFRPPEIAEVDLPSSHSQLKLPESDVLTVTVSGDNTFFMGVSSRQAKEKIFNTAVKPKLQAAKISEAEIRDSLKSFRLAESFPVGKDELDKFVLMARFANPKLRPVIRADDDAGFDAVNHAIKVYKKANMLTFNLVTVLEREVR

SEQ ID NO: 10448 - protein, 208 aa, Flavobacterium johnsoniae UW101
MAKIKMKKKSTSTDMTAMCDVAFLLLTFFILTATAKVPEALPVDMPSSTVQSKLPDSDLAIITIGQGKDGKSKVFFDIKGREIRKKTLEGMGAKFGVTFSEQDKEKFALMDDFGVPITSLKQIIDMKAADRTKAEQPGIPIDSLDNQLKEWLLVSRRATIDLDDKELQIAIKGDAKEQYPQIKKIMDILQDQKINSFNLVTGMRGKDF

SEQ ID NO: 10449 - protein, 177 aa, Chlorobium limicola DSM 245
MSRIKAKRVGFRIDMTPMVDVAFLLLTFFMLTTKFRPPEVVQIDLPSSHSELKLPESDVLTVTVSGDNTFLMGVSSQQSREKIFNSVVKPKLQAAGLSPAAVSDSLGSFRLTESFRVGREELDKFVVMARFADQKLRPVVRADADADYEAVDHVIKVYKKANLLTFNLVTMLEREVR

SEQ ID NO: 10450 - protein, 177 aa, Chlorobium phaeobacteroides BS1
MSKVKSKRIGFRIDMTPMVDVAFLLLTFFMLTTKFRPPEPVQIDLPSSHAEQKVPESDILTVSVSGDNRYFMGVSSQLSRTRIFERVVQPRLEAAGMSGIAVTDSLQGFKLAEVFPVRKNELPHFVTAARFANQRLRPVVKADANADFEAVNHVLKLFKESNILTFNLVTVLEKEVR

SEQ ID NO: 10451 - protein, 177 aa, Pelodictyon phaeoclathratiforme BU 1
MSRIKAKRIGFRIDMTPMVDVAFLLLTFFMLTTKFRPPEVVKIDLPSSHSELKLPESDVLTVTVGGDNTFFMGVSSQQSRVKIFNAVVKPKLQAAGLSSVAVADSLKKFKLAENFRVGRDELDKFVVMARFADQKLRPVIRADADAGFDAVNHVIKVYKKANLLTFNLITVLEREAR

SEQ ID NO: 10452 - protein, 177 aa, Prosthecochloris aestuarii DSM 271
MSKIKSKRIGFRIDMTPMVDVAFLLLTFFMLTTKFRPPEPVKVDIPSSHSEQKVPESGILTVTISGDNAYFMGVSSQPDRVALFERVIGPKLKASGADPAAVEDSLQHFKLAESFPVDRGEIERFVMTARVSNQKIRPVVKADMSADFEAVDHVLKVFKESNILTFNLVTALEKEGG

SEQ ID NO: 10453 - protein, 205 aa, Pedobacter heparinus DSM 2366
MPRAKVQRKSTSIDMTAMCDVSFLLLTFFILTATARQPDPLDVTIPSSTYKIKVPDTDMGILSIGKGKVFYEILGQDIRKATLPKMGEKYNIQFTPEEIKRFSVVGSFGVPIQNLKEFLNMNGEQRKKYQETSGGIPTDSTNNQLAEWLMQSRHSVAELHSTQMRVSIKGDANEEYPTVKKVVDILQKQKLNKFSLITSAEGSAE

SEQ ID NO: 10454 - protein, 204 aa, Dyadobacter fermentans DSM 18053
MAKVRPKKHAPHTDMTAMTDVAFLLLTFFIMTATFKSNDAEITTPTSISQIKVPDDKIMVISIDKAGKVFFGVDAQPTRAAMLDNIGQAKGITFTDAEKAKFALQSSFGLPLNQLKPWLNMPKEQMSQVKQPGIPVDSTGASELADWVYAARKADSQLRIALKGDNLSKFPAFKDVLANLQSQNINKFNLITGSEQAPAGYTND

SEQ ID NO: 10455 - protein, 218 aa, Chitinophaga pinensis DSM 2588
MPKVKMPRKSTLVDMTAMCDVAFLLLTFFMLATKFKPDEPVTVVTPSSINTKLLPDSDVIMLTVDKDGKIFFSMDGQPKRQQLINDLDQQYKLGLNEKEKNNFIIGSSIGTDIKSLKTYLDMKPEERKKAGLEKGIPSDSANNEVAVWIEYARSAQGGNPKLQYCIKADNGTPYPVIKDILDTFKEKKIQKLNLVTNLEAAPAGSAAAIARAEGKSDE

SEQ ID NO: 10456 - protein, 143 aa, Ruegeria sp. TM1040
MTKHVLCAIDLTHMDAEETLLKRAAELAEFYGATLSVVTVVPDYGMSIVGSFFKDGTMKEAVKEADRQLHAYVKKVVPDMKDVQHIVEVGANVYEMILDAIKRSEADLVVMGAHKPELMDRLQGPNSARVARYAPCSVLIVRD

SEQ ID NO: 10457 - protein, 141 aa, Mesorhizobium BNC1
MYKDILLSIDLGHAEDELRAVNTAVEYARSFGSRLHVMTVVPDYGMSIVGGFFPKEHEQKAIEHANEALHEFTKENVPSEIKHRHIVGHGSIYREILRYAGIVKADLIVLSAKRPGPEDYLIGPNAARVVRHAMISVLVVR

SEQ ID NO: 10458 - protein, 141 aa, Rhodobacter sphaeroides 2 4 1
MARTILLPIDLGNPTAPAAALNEALKLLDPEGTLHVVAVLPDYGYAQVSGFFRQGYEQEALKALGKALSAWVADNVPEGVAVHPHVLHGTIYDEILRAAGKLEVDLIVIGAHRPEFSDYLLGPNAARVVRHARQSVYVVRT

SEQ ID NO: 10459 - protein, 141 aa, Rhodobacter sphaeroides ATCC 17029; identical to SEQ ID NO: 10458

SEQ ID NO: 10460 - protein, 141 aa, Rhodobacter sphaeroides ATCC 17025
MARTILLPVDLGNPPANTAALAEALKLLEPGGRLHVVSVLPDYGYAQVSGFFRQGYEQEALKALGKALAAWVAEAVPDEVDVHPHVLHGTVYDEILRAAGKLGADLIVIGAHRPELSDYLLGPNAARVVRHARQSVYVVRN

SEQ ID NO: 10461 - protein, 145 aa, Vibrio cholerae O395
MYKHILVPVDLNEQGFADKAVQLAVWHAKHSNAEIHLLNVLPGIHMSMVATYFPKDAAAQMKNDVRAQLKAFAEKHIAEEVVYKLHIAEGKPYATILDYAERLGADLIVMPSHKRSRIDKVMLGSVASKVVENSPINVMVVKPQG

SEQ ID NO: 10462 - protein, 145 aa, Vibrio harveyi ATCC BAA-1116
MYKQILVPVDLNDQGFSDRAVELAVWQAKQANAEVHLLTVLPGIHMSMVATYFPKDAAAKMKQDVKQQLKAFADQHIDDEVIYKVHVAEGKAYATILDYAERLGADFIIMPSHKRSKINKVMLGSVASKVVENSPINVMVVKPQG

SEQ ID NO: 10463 - protein, 145 aa, Aliivibrio salmonicida LFI1238
MYKQILVPVDLNDKGFADKAVEMAVWHAKHSNAELHLLNVLPGIHMSMVSTYFPKGAAKQMKEDVSKQLNEFAAKFVDDDVVYRVHVAEGKPYVTILDYAERLGADLIVMPSHKRSKIDKVMLGSVASKVVENSPINVMVVKPQG

SEQ ID NO: 10464 - protein, 163 aa, Desulfomicrobium baculatum DSM 4028
MYKRILVPIDLQESDDRARCMGLERAIELCRLYKAQLYILTVVPDMGMPIVANYFPPDAGDKIVSEAEEMLHDMVGVYIPDDVEANYLVAQGSIYRRILRMAEKINADLVVMPAHRLKLQDYLLGTNTAKVVRHAACSVLVVRYDSEESCAIFDQSGDFEDEE

SEQ ID NO: 10465 - protein, 208 aa, Brucella suis 1330
MKTARFLLLLIATTLCFATMAEVHRLNLFATVEGGTVHGYGFFVGGGRPSEAQLIIRNAQGVELFKGPAGEDGSFSFTPAAPADLVLTLNAGDGHVAEAHIAADRFSQYGAQGAASSTKAETGTATPKGAALPASPSPEELSAMIDQSVDRAVSRQIAPLLEAYAEADGRARFSDIVSGIAVIIGLAGLFLWAKSRGRASHSDRQREP

SEQ ID NO: 10466 - protein, 215 aa, Desulfovibrio desulfuricans G20
MKLRTELRPGCICVVMLLMLTALPAQAHRVNVFAYAEGDRITVEAGYSKSRPVMGGTVVVADKADGDEFLRGVTDDNGIFVFTVPDAAKKEKADLRITLLAGEGHQDSWIVQAGEYAAETAPRDAAASGVTYSGRGAAGSRQAGAAAGAQGGHVSVDEALLRQVVEEVVERKIAPVRTMLVEQHESGPGFADILGGLGYFAGLFGIAAYLKSRRR

SEQ ID NO: 10467 - protein, 212 aa, Rhodopseudomonas palustris BisB18
MRMVVFSLALAAALLGPANQALAHKMKLFATVEGAIVSGYVYFSPGGRAQDAQITATAPDGATVFQGRTDPQGGFHFEAQRRVDYRIAADGGDGHEAGFTIKAAELPESLPGDLTAGNATAPTPSATMPPAVAVATAAPVPDLAALVEQSVARQIRPLREQLDSYQEVVRWHDVLGGIGYIIGLGGLAYGFASRSGHKLRRRLADGEKEAAQ

SEQ ID NO: 10468 - protein, 210 aa, Rhodopseudomonas palustris BisB18
MNKTIASLLLALVVAGGASGSAFAHKVVAGAFASGDRIEGEIGFSDGSMAKNVVVEVLAEDGSKLGEARTGEDGSFVFVPTKRVVHIFHADLSGGHVANIRLDVSDLPASLAAVAADGDAAVAVAPVPTGATPSAAAPPAGAPGPSAISDAQRAAFAEAVRNEIKPLRREIIALKEKNDLQSILGGLGYIVGLFGLWLFLAARRQKPLAG

SEQ ID NO: 10469 - protein, 175 aa, Rhodospirillum rubrum ATCC 11170
MFATVEGAEIVGSAYFGGGRYPQGVTVRFSAPDGRELGTAVTGADGGFRFLAREGVDHVIVVNSGDGHRAEMTVPARDLPPGLPGGAPNSAPAVPVAMASVVATGEGGTGNDLAALAGRDLAALDALLSRKLRPIEDQLDAQDDRIAFHDILGGIGYILGLVGLASLLLARRAKN

SEQ ID NO: 10470 - protein, 197 aa, Rhodobacter sphaeroides 2 4 1
MRRALLLLLALLLAGPAAAHSLRLFAKVEGREVSGYGFFVGGGRPHGAGWSARMAGLPLAQGETDAEGGFRFEVPEAVTGDVVIALDTGEGHMARVTLPPERFGGVPVPSGAIPLKAGGPALPAAEEPPSALAPTEKAPSPEVLRAIVSQAVEAEVAPLLERIEQMDARMRVTDIVSGLFLIFGGAGIALWARGRRR

SEQ ID NO: 10471 - protein, 197 aa, Rhodobacter sphaeroides ATCC 17029
MIRALLFLLALLLSGPAAAHSLRLFAKVEGREVSGYGFFVGGGRPHGADWSARMAGLPLARGETDAEGGFRFEVPEAVTGDVVIALDTGEGHMARVTLPPERFGGAPVPSGAIPLKAGGPALPVAEERPSAPAPTEDAPSPEVLRAIVSQAVEAEVAPLLERIEQMDARMRVTDIVSGLFLIFGGAGIALWARGRRR

SEQ ID NO: 10472 - protein, 190 aa, Rhodobacter sphaeroides ATCC 17025
MKLLLALVLVLAPLPAFAHKVIASVYPAGAAIEGEIGFSNGDMAANQRVTVTDPEGRPLGEVVTDAAGAFSFTPAEPIAHVFHANLGAGHVAEVTMPAEAVAALLGKASPATPPGAGAIPLTTAALAGGAAPLSRDEVAAMLRDELRPLRQEIAAYKEKNDLQTILGGLGWIAGLFGLGFYLAARRRMAG

SEQ ID NO: 10473 - protein, 210 aa, Brucella ovis
MKTARFLLLLIATTLCFATMAEAHRLNLFATVEGGTVHGYGFFVGGGRPSEAQLIIRNAQGVELFKGPAGEDGSFSFTPAAPADLVLTLNAGDGHVAEAHIAADRFSQYGAQGAASSTKAETGTATPKGAALPASPSPEELSAMIDQSVDRAVAVSRQIAPLLEAYAEADGRARFSDIVSGIAVIIGLAGLFLWAKSRGRASHSDRQREP

SEQ ID NO: 10474 - protein, 186 aa, Shewanella sediminis HAW-EB3
MYKHICLTFILSCCLVNTAQAHRTKVFAWVDGTNVVGEVYFGGGDRAKGSKVELLVGEQLVESTNADEQGEFRFERPQPGDYQLKANAGQGHVATFVISADEFLGLSGSAAGTIETQEVELEDEAGYKNRETCTALDEAALVKVIQPLRNQLDQYEANIRWHDILGGIGYILGVFGLWSLMRARRG

SEQ ID NO: 10475 - protein, 232 aa, Candidatus Desulfococcus oleovorans Hxd3
MKSVIGFTVGRHAVFGIVAGLVLCLLGMGPDRAHAHRVMVFAWIDGNTVLTQSKFPGDRPVSVGDIIVSDADGKQLLKGTTDEQGLFSFGLEQIPAPGPVTISLVAGMGHQASWTLTEPEVARAMGAEKPEPDDSLPVKEKADAESAGTVSPAAAATGTPESVVSSSSCLTEAQVEGIVERSLERKLSPAMNMLVTIQESMAVGVDDVVAGIGYILGLAGIAAYAYSRGRKG

SEQ ID NO: 10476 - protein, 266 aa, Desulfovibrio desulfuricans ATCC 27774
MPYCNSISYPHAPARDSARPLCFFLHMRGYTSPIPVSLLACLLAAALYFLSCTPAQAHRVNIFAWTEGRQVMVQCGFSGGNNVKNGQITVYDAANGTILLEGRTDTNGMFHFDIPPQGRKNGLRIRINAGEGHQNEWQLDAEELDQAPEPSGASPAQTGNTGSVPAAQPTDRPVTARGSTAQVEPAAVTSGNGVSIAIEEIRASVDAALEAQDARFNALLESRLAPLRRQLAEMRQDDPGLREIVGGMGWLVGLAGIALYLRSRHR

SEQ ID NO: 10477 - protein, 202 aa, Desulfomicrobium baculatum DSM 4028
MRSFFLLLVFTFLIPAPALAHRVNVFAYVEGGEVVVECSYSKSKRVRHGAIAVQDAGSGETLLQGTTDEAGLFRFSIPDQARTSGSGLRILLQAGEGHQNEWIVDAAEFMDAGAPRPLAPHAEVTAAGAMSPGRTDPGAAGLSRADVEDVVNAALDAKLAPIRRALLEQSQSGPGLQEIIGGIGWIFGLVGIGAYFKSRPRV

SEQ ID NO: 10478 - protein, 205 aa, Desulfohalobium retbaense DSM 5692
MRTLKRYGVLAGIVGFALLLAVDGWAHRVNIFCWVEGKEVVSESAFPSGTPVHEGTIRVFAEDADRKLLEGSTDTQGRFRFRIPKQAIDNAWDLRVEIDAGVGHVNSWMVQASEFATSGSSPKTTASQSQAAGTDRTDREVAASNAAELTPKELEAALERKLRPIHQKLSRLEQDRVSVQDVVGGLGYILGLAGIALYCSARRRG

SEQ ID NO: 10479 - protein, 104 aa, Methanosarcina barkeri fusaro
MNEILNLFLSLIAGFLLGAVFFGGLWWTVQKGLSSRKPAFWFLGSLLIRISIVIAGFYFVSDGHWERLLICLFGFFVMRHIIVRLTRLPEEDQNQLTKEASNAT

SEQ ID NO: 10480 - protein, 93 aa, Pelobacter carbinolicus
MIPTELGRMALALLTGLLLGAGYFGGLYLTVKSLKRCASPRLLLTASFLIRLLVVLGVFYLLSDWGALVMLTAMGGFLIARLGWLRSRYGRGA

SEQ ID NO: 10481 - protein, 101 aa, Chlorobium luteolum DSM 273
MTSEMLMGLLPDLLGGLLLGSLFFGGLWLTVRRGLASPRPWLWFGLSSLLRTMLVLAGFWWLAGNDWRGFLAALLGFTAAKVLAAVLSRKSPPYEGQAKEG

SEQ ID NO: 10482 - protein, 113 aa, Nitrosospira multiformis ATCC 25196
MNEIMSLLLALVGGVLLGAFFFGGLWWTVRRSIASPRPGTWFVGSMLLRTCIVTAGFYFLLELAAPGKKILFAAVVGFIIARVVATQFLPTPLSPSLVRMGRPGGSAISAGEH

SEQ ID NO: 10483 - protein, 104 aa, Rhodoferax ferrireducens T118
MNETLTLALAWVAGGVLGTIFFGGLWWTVRKGVSSKQPALWLFSSLLLRIGIALAGFYFVSGGHWERLLACLLGFVVARLVVTWMTRSSGKNQTRPAREASHAP

SEQ ID NO: 10484 - protein, 93 aa, Pseudoalteromonas atlantica T6c
LLIGLLLGCGFFYALWFTVQKGLQSPLPAAWFLGGILARMATAVAVFYWVSANDMWRLIACLLGFVIGRLLMTKWLTRFQNSHNEKRELPHAH

SEQ ID NO: 10485 - protein, 114 aa, Shewanella frigidimarina NCIMB 400
MENVLVDNIFVELTLALLAGALLGVFFFAGLWWTVRQLKSTQHVALLFIASLLFRSAIVIAGFYFIAGDNGYHLLAGLLGFMLVRLMATRYTLQVEQAQPLRKTLIVDKQEDRL

SEQ ID NO: 10486 - protein, 110 aa, Psychromonas ingrahamii 37
MIDQIFYRDIQILPLLPLLLAGAVLGVIFFAGLCWTVQRGIKSAHPGRWFFGSFLLRTAVALSGIYLLTDGQWPKLLACMLGFIGARIVVITITGSATNIANKQKPNHAP

SEQ ID NO: 10487 - protein, 106 aa, Polaromonas naphthalenivorans CJ2
MTMNETPALVLACIAGGALGAIFFGGLWWTVRKSLVSSRPALWVFASLLLRMGLTMAGFYVVSGGDWRRLLACLAGFVMARQVVTRLTRPLDARQALSDQEARRAP

SEQ ID NO: 10488 - protein, 118 aa, Marinomonas MWYL1
MLIDFSDNFWGGVAYAILVGMLLGVFYFAGLWWTVRRLGSSRVVAPLFLFSMLFRISVVMVSFYVFLGNDWQKLLLALLGFMVLRLFATRLIRLKDNPVIINPIHTLKEKHPHTEERL

SEQ ID NO: 10489 - protein, 104 aa, Prosthecochloris aestuarii DSM 271
MNDLMVFAALFFVGMFLGIFFFGGLWLTVQKSTFSRRPWLWFSISLALRTGVIFVGFYLIAPGGLVWLVSSLTGFVAARGLVIVVTRSFPVHQEQKEVPHASER

SEQ ID NO: 10490 - protein, 103 aa, Desulfomicrobium baculatum DSM 4028
MNETLTLVLALAAGVLLGGLFFGGLWWTVRKGVSSKRPAFWFFASLLLRMGITLTGFHFIAGGHLGRLLMCLLGFFIARLVVTRLTRTVEKPACLAQEAGHAS

SEQ ID NO: 10491 - protein, 113 aa, Ralstonia eutropha JMP134
MTRVRQARHVSPRAVIAGAAVLLVAIMLAAALGRLYGRHLNPSGRLGVPTPTTPEATLPLSESAPQTERARFDADKQAVLKGWGWVDKRAGVAHIPVERAMALMAETPPEPAR

SEQ ID NO: 10492 - protein, 130 aa, Nitrobacter hamburgensis X14
MPNDRPESPAVATRAVLFTAIGFLVFVGISLVVLRIFYGERTGHVVFVPPTLFAKPRLQTNDAADLARLQAEQRGRLGGYAWVDREKGIIAIPIEEAMKRVVARGADAYAPIDSNTSAKQPAGAGGGQSP

SEQ ID NO: 10493 - protein, 178 aa, Candidatus Koribacter versatilis Ellin345
MDTNNHSHPAVNTDVGFDKSDLSVRGIVIFLAGVGIAGVVSHLVIWGMFVGAQKVVPYDQNPNPMATMVTGTEAPPLTNAGPQSVVSFPEPRLQTDDTADMSKFKEEEDKHLYAAHPYQGADGTIHLNINDAMALVAQRGLPTRQAGQQPTATANTDKQTAPKPAAGAKPAAGSPGVQ

SEQ ID NO: 10494 - protein, 135 aa, Methylobacterium sp. 4-46
MPADASPEIPAPPEAPGVPVRTVLAAVAGFALFVAAAMGGLKLSYDRGAPRRERPPPRAMPQPGLQIDPAGDLKRLLDAQGEALSGYAWVDRERGIVRIPVARAMEILAGRGAAALDPVGAPAAAPGPIKESRRP

SEQ ID NO: 10495 - protein, 130 aa, Gluconacetobacter diazotrophicus PAl 5 JGI
MPDDPAPAAPPHFSRPRHEVRDVALRPVLVVGIGVGVAVVMLAVLANMLFPQHTLDTELRGPLPRMAAPALQSDPPADMAAFRAADLARLNGFGWVDRAGGVAHVPIDQAMRQVARDGIPDWPSAGADRP

SEQ ID NO: 10496 - protein, 134 aa, Methylobacterium nodulans ORS 2060
MSTDAARKDQPPEAPGVPVLRVLGPVFGFAVFTGLTMGALKLYYDRTTLPHGQVPPRAMPQPGLQLDPPGDLKRLLDAQHENLSHYGWVDRDHGVIRIPITRAMEILAGRGAAAFDPVGAPASAPGPIKESRRP

SEQ ID NO: 10497 - protein, 134 aa, Chloroflexus aggregans DSM 9485
MSHANAHSEGPSAESLALNHEVSDARSTPVIWGLVIVFGTLLLAFVLMGLVLSLTAGSITDASNTLRDDEVTQLQLPPAPRIEQNPRIDGDRIITEAKERLESYGWVNERAGRAHIPIERAMELLIEHGLDTGK

SEQ ID NO: 10498 - protein, 143 aa, Pelobacter carbinolicus
MQRLGGLGTAGNGLENHADAEINMMPLIDMIFILLIFFLVTASFVRESGIEVNRPEAVTAVKKEAVGMVVGIAGDGRVFIDHQVVDVRRVRGLVEIFLAENVDGGIIIDADSACTAGRMVAVLDQCRMAGAQNIAVSARRPGE

SEQ ID NO: 10499 - protein, 136 aa, Desulfovibrio desulfuricans G20
MQSIRYTRAARNRRSEVNMTPLIDMVFILLIFFIVTTSFVRESGIDVNRPAAQSAETKEKANVILGLTSEGRIYVEGRTLDIRSVRAYMERFLAETPEGSVVIVADKQSMTGNAVQVLDQCRLAGVRNISIAAKKE

SEQ ID NO: 10500 - protein, 136 aa, Chromohalobacter salexigens DSM 3043
MRRRRLQDVNDDAQEINLTPMLDVVFIMLIFFIVTTSFIKESGVEIERPESSAATARPDAQVMVAITAEDAVWVDGQPVDAHRVGNEVASLVSDEGGVVIQADRQSTTGLLIEVMDAIRDAGVDDVAVAAERGADG

SEQ ID NO: 10501 - protein, 128 aa, Campylobacter fetus 82-40
MRLAKRDGLNIVPFIDIMLVLLAIVLSISTFIAEGNIKVDLPKAQSATNSDESARVIIAIDKNSNIFIDDKLVLENEIAYKISNISPETLIILRSDKSSKFESFIKVIDALKSQNHEKFAISAKVSNE

SEQ ID NO: 10502 - protein, 134 aa, Psychromonas ingrahamii 37
MKLSKKNFQQPARFELLPLLDVIFLLLIFFVFVMLKMTMQSSINIELPQLVDSQQQTEELLVISINSKNQLFINEEVTTEELMLAQVINLQKDNKLPILIRGDKKSDLGVALSILDKLRLSGFHHVAFATDKDQ

SEQ ID NO: 10503 - protein, 141 aa, Anaeromyxobacter sp. Fw109-5
MAAHSNGSDEAITGINVTPLVDITLVLLIIFMVTASYIVKEGIEVDLPRAAHGGETVGPTLAFAIDRDGKLYLDGQPVGRDAARAAVRAALARSAEARALIGADRAVPHGEVVSVIDLVKSEGLTRFAIQIERDASGEGAP

SEQ ID NO: 10504 - protein, 139 aa, Candidatus Desulfococcus oleovorans Hxd3
MLNISAARRAGKRGVELNMAPLIDMIFILLIFFLVTTSFVQETGLDIDKPSAATAVVRESADLVIGITRENRIFMGRREIDADRLRLAVERAITEKPEAEVLIVADTQSATGTVIEVMDACRLAGARAISMAAGIPEQQ

SEQ ID NO: 10505 - protein, 140 aa, Anaeromyxobacter sp. K
MAAHSNDPDDAITGINVTPLVDVTLVLLVVFMVTATYVVKDGIDVDLPRAASGGESTGPTLAFTLDRGGHLFLDGAPVERDAARAAVRAALARSPEARAVIGADRAASHGAVVSLIDLVKTEGLTRFAIQIEREDAGAAR

SEQ ID NO: 10506 - protein, 140 aa, Anaeromyxobacter dehalogenans 2CP 1
MAAHSNDPDDAITGINVTPLVDVTLVLLVVFMVTATYVVKDGIDVDLPRAASGGESTGPTLAFTLDRGGRLFLDGAPVERDAARAAVRAALARSPEARAVIGADRAASHGAVVSLIDLVKTEGLTRFALQIEREDAGAAR

SEQ ID NO: 10507 - protein, 142 aa, Desulfohalobium retbaense DSM 5692
MASGRRYRQSDKRSQTELNLTPLIDMVFILLIFFLVTSHFARETGIEVSRPEAASVESAPAQHLRITIRADNQIFIRGQHVDIRRLQEHLESRLRDQPLQAAVVTADEASRSGTLVQVLDACRLSGLDDVTVAGRRPEESGP

SEQ ID NO: 10508 - protein, 209 aa, Nitrosococcus oceani ATCC 19707
MNFQPSPLQALILWRLLTSEGRAYLTDIRPKPKRRDREALLEAKFIEEQWRRKPQGSRAIYVQLTDRAWAWAGEHMDAKLSHRSPAAGPILQSFLARLQPILQSRHITLAEIFSSTQAPPPSEDSEQQLREAYFHLSGGERNIRVRLAQLRQQLGAIPRPRLDELLLKLQREGKLVLSPLDDSREILPEDQKAALSVAGFKRHLVYMQK

SEQ ID NO: 10509 - protein, 238 aa, Rhodopseudomonas palustris BisB18
MAASRKSKHPKPADKPRPKTREQKDAEKQALAMWALLGAGGAGYGRKLKPEIEKAEREALIKAGLIESRPRENRALWLTVTDRGWDWAERHLGDPLPEKNYSGAFVLQAWLTRLKTYLQARDLRLADVLAASAVPDPGGSAEADEAPAPADPAELREKIRNAYLAVAGGFNRRALLKDLRAKLPEIDRATLDDALKQMQREQQASLMQLDNRIDVTDADRDAAIQIGNEPRHIVWIEN

SEQ ID NO: 10510 - protein, 205 aa, Mycobacterium vanbaalenii PYR-1
MTVTATDLTGTERAVLLVLMAESRPVPNPELAALGPALDKPGRDKLNRLGLIESERVGNRFVHELTDRGWRLCRDLLAAGAPPRSTGPAKTLYTVLGALGRYLQHTDLSLADVFGAAEPPASVEERIRAAYDVLATRPGGWVSLTRLRAELDAPRADVDAALVALHRTPGVSVIPEENQKTLTAEDRAAAVVIGDRPKHLIAIEA

SEQ ID NO: 10511 - protein, 206 aa, Mycobacterium gilvum PYR-GCK
MSVTAGELTGTERAVLLVLMAASRPVPNRELAVLGPALDKTGRDKLNRLGLIESERVGSRFVHELTDRGWRLCRELIDAGPPPRSTGPAKTLYTVLGALGRYLDGAGLSLADVFGASHGGPARTEDRIRTVYTRLAGRPGGWVSLTALRAELDAPRAEVDAALAVLHRTPGVSVIPQEDQKLLTPEDRDAAVIIGDRPKHLIAIED

SEQ ID NO: 10512 - protein, 270 aa, Frankia EAN1pec
MTRDSSASRGGSATRDATALTVRQAAILLALLTQTQPISNSELRDRFDFTLVGDDRRRLNELGLVGSKKIRGHGNVLFHELTDAGWNRASRELTPSAEFTRLSVPAGVFFAFAEGVARLLVREQRAIGEALGAYAGPPDPGSDGSPEADPAGTGPLSAASAPKTATAETEMEADAEADRSGNPASLETTIRAAYASLATDAHDWVRLADVRPLLGGVDRKQVDRVLRQMARRPDVRVVPDEDQKSLTAADRAAAVRIGEHDNHLLLIGPV

SEQ ID NO: 10513 - protein, 282 aa, Methylobacterium sp. 4-46
MSETLTPRRGLILWCLLGRQGSALQSEVRPAVARLDREALIERGLVAAEKQGRSLRLTVTERGWRWASDHLHAPLPETFRVLQDWLGLVARHLDATGATLADLVGEAPAPTREALPARQARILRALIDAQGSASPRDLKPAASRADREALVAAGLVAQEPRGRSVRLTVTEAGRHWARTHLGLALPGGQEAAPAPAALERIEAAYLALTDGRRREAVRLSRIRAELADLDRASVDAGLALILREGRKARLMQITDPRGLDAAERAAAFSPAGEPFHLLWIEP

SEQ ID NO: 10514 - protein, 200 aa, Actinosynnema mirum DSM 43827
MIEERLTPHERAVLLVLMAEARELTNPQLREVAGFTLDGAARRRLNGLGLVTSTKVGRGFAHELTDRGAVRCAEELTAPRQPRSGSAGGALAAVLAGLKRHLDATGGTVAEVFRPDPVVLVLAAHDAASGGRGGSVPLADVRERLLGVPRADVDRALGELALREDVRLWGEADQKALTDRDREAAVVLGGTARHLLVVAR

SEQ ID NO: 10515 - protein, 154 aa, Nitrobacter winogradskyi Nb-255
MIHSTAAADRHLHLIKLAVGCESVKELRDWIAERMKQATLEGLPRHHIHITRMTPKRGEELLAGGSLYWVIRGEIAAREKLIGIEPFRDGDGIGRCRLVMQPKVVAVRPRPMRPFQGWRYLSLADAPPDLGSNAASVAEMPEPLRRELRDLGLL

SEQ ID NO: 10516 - protein, 145 aa, Rhodopseudomonas palustris HaA2
MALNLIKLAVGCESVKDLTSRVAERAKLARQQGLPRQHVHITRMVPKRDAELLDGGSIYWVIRGEIAAREKLIGIEPFRDGDGIGRCRLIMEPKVHAVSPRPMRPFQGWRYLTTADAPPDLGKAAESIAAMPEPMRRELRELGLL

SEQ ID NO: 10517 - protein, 145 aa, Rhodopseudomonas palustris BisB18
MPLHLIKLAVGCESVKDFESRVSARAKLAKAQGLPPRHIHVTRMTPKRDAELLDGGSIYWVIRGEIAAREKIVAIEPFRDGDGIARCRLIMQPKVIAVAPRPMRPFQGWRYLAATDVPPDLGSAAASIAAMPEPMRRELRDLGLL

SEQ ID NO: 10518 - protein, 145 aa, Rhodopseudomonas palustris BisB5
MALHLIKLAVGCESVDDLTSRIADRARLARQQGLPPQHVHITRMVPKRDAELLDGGSIYWVIRGEIAAREKLIGIEPFRDGDGIGRCRLIMEPKVHPVNPRPMRPFQGWRYLKTSDAPPDLGKAAESIAAMPEPMRRELRELGLL

SEQ ID NO: 10519 - protein, 151 aa, Nitrobacter hamburgensis X14
MRAAADIHLNLVKLAVGCESLKEFRNWIAERMKQAKRNGLPRHHIHITRMTPKRDEELLAGGSLYWVIKGEIAAREKLIGIEPFRDGDGIGRCRLVMQPKVIAVRPRPMRPFQGWRYLSAADAPPDLGSNAASVAAMPEPMRRELRDLGLL

SEQ ID NO: 10520 - protein, 146 aa, Bradyrhizobium BTAi1
MPLHLIKLAVGCESVKELKEWIAERMLAAKKKGLPQQHVHVTRMTPKRVDEILAGGSLYWVIRGEVAAREKIVGIEPFRDGDGIGRCRLIMQPKVIAVSPRPMRPFQGWRYLTPEDAPADLGKAGAAGLEAMPEPLRRELRDLGLL

SEQ ID NO: 10521 - protein, 144 aa, Xanthobacter autotrophicus Py2
MTLHLIKLCVGATSIADLEDWIAQRAEAARKAGQPFEQIHVTRMVPTRREELLDGGALYWVIKGEVAARQRLLDLRPFVDGDGVRRCGLVLDPQVVPVEPRPSRPFQGWRYLKASEAPRDLAQPEDGGALPEGLARELRELGLL

SEQ ID NO: 10522 - protein, 139 aa, Rhodopseudomonas palustris TIE 1
MALHLIKLAVGCESVKDLTERVAERARSGGRHIHITRMVPKRDAELLDGGSLYWVIRGEIAAREKLVAIEPFRDGDGISRCRLVLEPEVHPVSPRPMRPFQGWRYLTASDAPHDLGNAAEGIAEMPETMRRELRELGLL

SEQ ID NO: 10523 - protein, 107 aa, Nitrobacter winogradskyi Nb-255
MLDRDEDILKAAESWAEAGKGVALATVVETWGSAPRPAGSGLVVNEDGTFLGSVSGGCVEGAVVTEALDVISSGAPRMLEFGVADEAAWTVGLSCGGRIRVFVEKVV

SEQ ID NO: 10524 - protein, 107 aa, Rhodopseudomonas palustris HaA2
MLDRDEDILKAAEDWKKAGHGVALATVVETWGSAPRPAGSSLVINNDGTFLGSVSGGCVEGAVVTEALDVIESGQPKLLEFGVADETAWKVGLSCGGTIRVFVEKVG

SEQ ID NO: 10525 - protein, 107 aa, Rhodopseudomonas palustris BisB18
MLNRDDDILQAAEDWRNAGHGVALATVVETWGSAPRPAGSSLVINDDGTFLGSVSGGCVEGAVVTEALDVILSGAPKLLEFGVADETAWQVGLSCGGTIRVFVEKVS

SEQ ID NO: 10526 - protein, 107 aa, Rhodopseudomonas palustris BisB5
MLDRDEDILKAAEDWKNAGHGVALATVVETWGSAPRPAGSSLVINNDGGFLGSVSGGCVEGAVVTEALDVIESGQPKLLEFGVADETAWKVGLSCGGTIRVFVEKVG

SEQ ID NO: 10527 - protein, 110 aa, Nitrobacter hamburgensis X14
MAAMLDRDDDILKAAEDWQKAGHGVAIATVIETWGSAPRPAGSSLVVNDEGTFLGSVSGGCVEGAVVTEALDVISSGVPKMLEFGVGDETAWTVGLSCGGTIRVFVEKVG

SEQ ID NO: 10528 - protein, 104 aa, Rubrobacter xylanophilus DSM 9941
MNPVVERVARWREEDKRCALATVVKVERSGPLGPGTSMAVSEDGEVVGSVSGGCVEPAVYEEAMSAIQTGEPRLLTYGISDEEAFGVGLTCGGVIHIFVERVDW

SEQ ID NO: 10529 - protein, 112 aa, Mesorhizobium BNC1
MPQSVETHEPRDPLLIAEEWMKDGKDVAVATVVETWGSAPRPVGSHLVIDSEGLFEGSVSGGCVEGAVIAEAAEVIADGKPRMLEFGVADETAWRVGLSCGGRIKVYVERLG

SEQ ID NO: 10530 - protein, 110 aa, Acidiphilium cryptum JF-5
MSDTASDAEDILGIAAAWHEEGEQVAIATVTSTWGSSPRRVGSRMAVTASGRIAGSVSGGCIEGAVAEAAQRSIETGTPQRLDYGVTDERAWEVGLACGGKVSVFVEKLS

SEQ ID NO: 10531 - protein, 107 aa, Bradyrhizobium BTAi1
MLNRDEDILKAAEDWRTSGHGVALATVVETWGSAPRPVGSNLVINDDGTFLGSVSGGCVEGAVVTEALDVISSGQPKMLEFGVADETAWNVGLSCGGTIRVFVEKVG

SEQ ID NO: 10532 - protein, 110 aa, Sinorhizobium medicae WSM419
MQNEPNILDPLAVAETWHEQGRAVALATVIETWGSAPRPVGSHLVIDGEGNFQGSVSGGCVEGAVIAEAADVITSGTPRLLEFGVADETAWRVGLSCGGRIRVYVERIDG

SEQ ID NO: 10533 - protein, 111 aa, Parvibaculum lavamentivorans DS-1
MTEPAANHDQVLEEAARWRAEGHKVALATVIETWGSAPRPVGSQLAIRDDSEFVGSVSGGCIEGDVVTRALDALATGKPEIVEYGVSDAMAWEVGLACGGRIRVMVEPVSG

SEQ ID NO: 10534 - protein, 108 aa, Rhodopseudomonas palustris TIE 1
MQLDRDEDILRAAEDWRKAGRGVALATVVETWGSAPRPAGSSLVINDEGTFLGSVSGGCVEGAVVTEALDVIDSGTPKLLEFGVADETAWKVGLSCGGTIRVFVEKVD

SEQ ID NO: 10535 - protein, 107 aa, Methylobacterium sp. 4-46
MLSTDTDILSAAQAWREAGRGVALATVIETWGSAPRPVGSHLAIDQEGNFLGSVSGGCVEGAVITEALEVIEEGRPRVLEFGVADETAWRVGLSCGGRIRVLVERVA

SEQ ID NO: 10536 - protein, 107 aa, Methylobacterium nodulans ORS 2060
MLSTDTDILSAAQGWREAGRGVALATVIETWGSAPRPVGSHLAIDQEGNFLGSVSGGCVEGAVITEAVEVIEDGRPRILEFGVADETAWRVGLSCGGRIRVLVERVD

SEQ ID NO: 10537 - protein, 189 aa, Brucella suis 1330
MTTNRKWLYAGAVLAALLQTGILYAGIEKRAAILRSGQDIVFQTEPVDPRDLMRGDYVVLGYEISNIARSAIQGVRPAGSRTVYVAVKPDAKGISRFSRASFVPFKDLAAGETQIRGEAGYEISDDPEANIRLSFGIERYYVSEGEGHPIEGSQREHDITVLVAVDASGSPVIKALMDEGQPLYEEPLY

SEQ ID NO: 10538 - protein, 189 aa, Brucella ovis
MTTNRKWLYAGAVLAALLQTGILYAGIEKRAAILRSGQDIVFQTEPVDPRDLMRGDYVVLGYEISNIARSAIQGVRPAGSRTVYVAVKPDAKGISRFSRASFVPFKDLAAGETQIRGEAGYEISDDPEANIRLSFGIERYYVPEGEGHPIEGSQREHDITVLVAVDASGSPVIKALMDEGQPLYEEPLY

SEQ ID NO: 10539 - protein, 189 aa, Ochrobactrum anthropi ATCC 49188
MTIRLKWLYVGATVTALLQTGILYAGIEKRASVLRSGAEVTLQTEPFDPRDLMRGDYVVLGYEISSLSRKDIQGERPAGSRTVYVAVKPDTNGIARFSRASFVPLSDLTSGEEQIRGEAAYSISDDAESNIRLNFGIERYYVPEGQGRAIEDSQRERRITAVVAVDPNGTPVIKALQEDGRQLYQEPLY

SEQ ID NO: 10540 - protein, 174 aa, Campylobacter curvus 525 92
MRLKLVLGAVIFQILALLAMLVNAFAPLYFGKDIRVDVSLYDPRDLLRGNYVSLQYDFTRNLPIFHGAYDEEVDENQSIGKDKIYVSLKPDENGTYQSDGYSFERPKDGVFIVGSMDYEGAKFGIEAFFMPPQKAIQMEKDIRESGAYAILAVMDNGKARVKDIVPKGKFYIKF

SEQ ID NO: 10541 - protein, 199 aa, Parvibaculum lavamentivorans DS-1
MNARFGLALIALALGQSLFLAVMVWDRVSLLRSESVVTLKTEPVDPRDLFRGDYVILNYEISRLRLDTLEGDDGFAQGDTIHVELAPAGDLWQPVAAWRDHREPAAGNEIIRGRVSWVIDARPVASPADGEEMPCLDCGTATIAYGIESYFVPEGEGRSLEDQRNAGNLTVDVALGRDGEGAIKRLRLEGEPVYEEPLF

SEQ ID NO: 10542 - protein, 216 aa, Campylobacter concisus 13826
MKIRSLILAIIFQILLIIAMLAYALMPLYLGKEIKVRVNLYDPRDLFRGNYVSLSYDFSDFSNLQQSKFDEKTGVEIYIYDRNISKNDEIYAILKQDANATYAFDKFSFTKPKDALFLAGKFDGYLFVKYGIEEFYMPTKKAKQTEREMMDQDVDAVAVLMVMDDGRARLKDLIITPNGKKRSNDENFDENGYIDDNESIDDNESFEEPVRLQDQR

SEQ ID NO: 10543 - protein, 183 aa, Shewanella sediminis HAW-EB3
MNTMTVPGWLHKKPGKRTIQIGLILTLFFQLSVLSIEYLGSVLPIWTGEEIILKTEPVDPRSLFRGNFVRLNYEINRIPTEPQTEFKMGSLIYVSLVEINGIWQFDTFNTAKPKMGTYIRGRVRRVDSGTVRVEYGIEAFFMPKEKALKVQNEMGGQAQVRVFVAPNGKARAVGFKCLGDACL

SEQ ID NO: 10544 - protein, 190 aa, Shewanella woodyi ATCC 51908
MESLVTPLLRKGSPSKRFVQIGLFLTILFQLSVLCVEYLGAVWPIWTGKAVVLKTQPVDPRSLFRGNYVRLNYDISRVERKDAEAFKLGSVVYLTLEENSGLWQAKEVTRDMPSEGDFIRGRVRSHYGEVLSIDYGIEAFFMPKEKALAVEKEMQGTGTAQVEVFISGSGKARAVGFICIAKSCDEYPDD

SEQ ID NO: 10545 - protein, 212 aa, Methylobacterium sp. 4-46
MIRDLLPRLRGAPASAALFGLVFLVQALPAVTVAVEQSRRLTTGRPVLLATATRDPRDLLRGEYSVLSYEIGQPANLPAAPDLAASCPAQGACPLAAGTTVYVTLVPGEDGLSRAAAVAAAPPADGALALRGTVRFGTLVPGGSAVCPAARCLAGAVTYGIERWYGPQGAPAALDRLDRGRIRIRARVDAAGGAVLDAVLVDGREVARTPRL

SEQ ID NO: 10546 - protein, 196 aa, Rhizobium leguminosarum bv  trifolii WSM2304
MNSLMARLHSGRGYLLSAIIVAGLQTVILGTIIQSRASILNNGAEVLLKTAPVDPRDFLRGDYVVLNYDISSVPVQTVSGGIPAEPGERTLWVRLKKQEDGFWTVIESSFRELPPLPETVILRSQPFYSGGLAAGDSIRVEYGIERYYVPEGQGKPIEEARNGGNVAIAVRVSPAGSAQIRGLLVDGKPVYDEPLY

SEQ ID NO: 10547 - protein, 211 aa, Methylobacterium nodulans ORS 2060
MTRLALPRAGGALAAVAFALLFVVQAAPAVKVALDQSRRLEAGRAVLLAAATRDPRDLFRGEYSVLSYEAGQPAGLSASEDLARACGPEPGCRLPGGMTVYVTLTEGADGLHHAAAIAATKPTGTNPFLRGTVRFGSLTRDGGRSPCAGLCFSGAVDYGLERWYGPQGVPADLDRLDRGRIRIRARVDGEGTAILDALLVDGREVARTPRL

SEQ ID NO: 10548 - protein, 193 aa, Agrobacterium vitis S4
MMQRNHIFRLVSAAILLAALQTAAIGYQIGERANILRNGQEVLLRTEAVDPRDLLRGDFVVLNYPISRIPEEKIIGPRPSSRQDVRLHVRVVPQADGFATVEEASVADLPAKPGSVVLLSEPLSFPSPLAPGDSLTVHYGIERFYVPEGEGRDIEAQRNQGAVSIAIRVSHAGRAQIRQLFVAGQPVYREPDF

SEQ ID NO: 10549 - protein, 196 aa, Rhizobium leguminosarum bv  trifolii WSM1325
MSSFMARLQSGKGYLLSAIIVAGLQTLILGTIIQSRASILSDGAEVLLKTAPVDPRDFLRGDYVVLNYDISSVPVQTVSGGIPAEAGERVLWVRLKKQEDGFWTVTESSFHELPPQPETVILRSQPFYSGGLAAGDSMRVEYGIERYYVPEGQGKPIEEARNDGNVAIAVRVSPDGSAQIRSLLVDGKPVYDEPLY

SEQ ID NO: 10550 - protein, 133 aa, Dehalococcoides ethenogenes 195
MGDKWIGVALSDPLRILASPLVILRRDDDAKTVENIEALVKTHQPDLLVIGLPVSLNGTIGPQAEKVKAFSGLLSQSLNTEIIFRDERFSTDEARRKMNDSGKNNKTVRDDAAAAAVILQDYLDETNPPCFQP

SEQ ID NO: 10551 - protein, 159 aa, Thermobifida fusca YX
MRTGVRLAVDPGAARIGVARSDPDGILAIPVETIRRGPGDLDRIAALVLEYEAREVIVGYPASLSGAEGRAARAARAFAKALARRLAPVPVRLVDERLTTVTAELHLRTGASYRKRGARGGRARRSVIDQAAATVLLQNALDTERRTKLPPGELVEGTP

SEQ ID NO: 10552 - protein, 202 aa, Frankia CcI3
MSGSGSRPGDSRPGDSRPGDSRPGVRIGVDVGSVRVGVAASDPGGVLAVPVTTLARDRRGNADIDQLVLIVRERQAVEVVVGLPRQMSGQEGRAVRLVRQYAEVLAERIAPVPVRFVDERLTTVAAHRRMAERGVRSRARRSLVDQEAAVQILQHDLDSRRGSAAPGVIGCAAPAAGPDGVVRAPRDGPRAPDGVVPPSDER

SEQ ID NO: 10553 - protein, 169 aa, Mycobacterium MCS
MTDSDHRLPDRPGEGDPGRGRRIGIDVGSVRVGVATSDPDGVLATPVETVRREKSSDRHVRRLAQLVTELEAVEVVVGLPRTLADRTGPAAHDAIDVAEALARRIAPVPVRMADERLTTVSAQRSLREAGVRAKGQRAMIDQVAAVGILQSWLDQRRAALAAPGEGGHG

SEQ ID NO: 10554 - protein, 139 aa, Rubrobacter xylanophilus DSM 9941
MSPPEGRVAALDLGEVWTGVAVSDPTRTLARPLEVVRTSELPGVLRRLVREEGVGEVLVGLPRTLRGEVGFQARRVSDRLSSLRAGFPEVRFVEWDERLTTKVVSGPLREGRRRGRRERVDHLAAARMLQEYLELGGGA

SEQ ID NO: 10555 - protein, 199 aa, Arthrobacter FB24
MNQSVESDAYPRGIKLGVDVGTVRVGVAVCDRDGILATPLKTLERNAKKNTDVRVLAGLASELGAVQVFVGLPRTLKGEEHASARMATDYAELLAEALAARGSDIPVQLVDERLSTVTAHRNLHEAGMSSRNHRKVVDQVAAAGILQHAIDMQKARGTDVGSRVFAVSQPGLSGDAAAENADPAVPGINVQSSENGRQQ

SEQ ID NO: 10556 - protein, 173 aa, Acidothermus cellulolyticus 11B
MGDTAVRPGVRIGVDVGTVRIGVAVSDPDGRLAVPAETLPRDASGAGELRRLAQLVEERGAVEVVVGLPVSLRGTAGAAARDIAGYARRLATAVHPVPVRLVDERFTTVHADRRLQSAGLAGRQRRAVVDQLAAAILLQDALDAERATGRPPGRLVTPADPDDTAAARRREAG

SEQ ID NO: 10557 - protein, 156 aa, Nocardioides JS614
MRAGVRIGIDPGDARIGVARSDPSGFLATPVETVRRGKGDLARIGRILAAEEDEGATVLEVVVGLPRSLSGREGPAAAKVREFAGRLAARVAPVPVRLVDERMTTVSAEAMLRDQGRTGGKRRAVVDQAAAVLILQHALDTERATGAAPGEIVEET

SEQ ID NO: 10558 - protein, 169 aa, Mycobacterium KMS; identical to SEQ ID NO: 10553

SEQ ID NO: 10559 - protein, 175 aa, Mycobacterium vanbaalenii PYR-1
MPDTDWTSRVPDRPGDPNTAPDPGRGRRLGVDVGTVRIGVAVSDPDAILATPVETVPRDKRGTKHVRRLAALVDEYQVVEVVVGLPRTLADRAGSSAQDATEVAEVLAGRIAPVPVRLADERFTTVTAQRALREAGVRARGQRSVIDQAAAVGILQNWLDQRRAALPAHGEVLDD

SEQ ID NO: 10560 - protein, 169 aa, Mycobacterium JLS
MTDSDHRLPDRPGEGDPGRGRRIGIDVGCVRVGVATSDPDGVLATPVETVRREKSSDRHVRRLAQLVTELEAVEVVVGLPRTLADRTGPAAHDAIDVAEALARRIAPVPVRMADERLTTVSAQRSLREAGVRAKGQRAMIDQVAAVGILQSWLDQRRAALAAPGEGGHG

SEQ ID NO: 10561 - protein, 175 aa, Mycobacterium gilvum PYR-GCK
MPDTDWTSRVPDRPGDPNAAPDPGRGRRLGIDVGSVRIGVAVSDPDAVLATPVETVTRDRRSGRHLRRLTTLVGEYEAVEVVIGLPRTLGNRAGSSAQDATEVADQLAARIAPVPVRLADERFTTVTAQRELREAGVRARGQKSMIDQAAAVGILQNWLDQRRAALPAHGEVLDD

SEQ ID NO: 10562 - protein, 153 aa, Salinispora tropica CNB-440
MAEWSRGVRLGVDVGQVRVGVARSDPHGVLATPLVTLARDRAVAPEAVPSDMAELAALVTEHEAVEVVVGLPVNLAGRQGPAAVHVQAYVGRLVEVISPVPVTLADERMSTVVASRRLAERGVRGRRQRAVVDQAAAVEILQSWLDAQRRRMQ

SEQ ID NO: 10563 - protein, 133 aa, Dehalococcoides BAV1
MGDKWIGAALSDPLRILASPLVILRRDDDTKTLENIESLVKTHQPDLLIIGLPISLNGTIGPQAEKVKSFSELLSRHLNIEIIYRDERFSTDEARRKMNDSGKNNKTVRDDAAAAAVILQDYLDETNPPCCQP

SEQ ID NO: 10564 - protein, 170 aa, Mycobacterium tuberculosis F11
MVPAQHRPPDRPGDPAHDPGRGRRLGIDVGAARIGVACSDPDAILATPVETVRRDRSGKHLRRLAALAAELEAVEVIVGLPRTLADRIGRSAQDAIELAEALARRVSPTPVRLADERLTTVSAQRSLRQAGVRASEQRAVIDQAAAVAILQSWLDERLAAMAGTQEGSDA

SEQ ID NO: 10565 - protein, 188 aa, Frankia EAN1pec
MTAPDSAAGADSAAGSDSAAGGQADAGRGVRIGVDVGSVRVGVAVSDPDGLLAVPVTTLRRDVSRRGFADVDELADIVRDRHAVEVVVGLPRHLSGREGEAVRLARRYAEVLSARVAPVPVRLVDERLTTVVAHRRMAERGLRSRARRDLVDQEAAVQILQHHLDVRRARGGSGGAASGGTGRPLDSA

SEQ ID NO: 10566 - protein, 153 aa, Salinispora arenicola CNS-205
MAEWSRGVRLGVDVGQVRVGVARSDPHGVLATPLVTLARDRDAAPDAVPSDIAELAALVAEHEAVEVVVGLPVNLAGRHGPAAVQVQEYVGRLVEVISPVPVTLADERMSTVVASRRLAERGVRGRRQRAVVDQAAAVEILQSWLDAQRRRMG

SEQ ID NO: 10567 - protein, 152 aa, Bifidobacterium longum DJO10A
MVWLGVDLGNARVGLALSDPELTFAHPAGNIHVAGDYFFAIDEVLNVIEDEHVDHVIVGLPLQMDGTEGKSAKKARRWAANLEKRLQAESEDSDSTEYQIPQVSLIDERLTTVSAHRQLFEAHKASNKHRPVVDQQSAVVILQTALDRTREQ

SEQ ID NO: 10568 - protein, 147 aa, Mycoplasma arthritidis 158L3 1
MRKLCLDLGKKTCGFAISDVNQTIAIGLENFFYEEYHFYEVINRIKYYLEESEFQGQVDEIILGLPLRMDLSESKTTKMVKKFATVLAKNITLPIRLQDERQSTKNAEAILSQGGYNAKQKKLKKDSLAAQLILEDYLERQHHEKSN

SEQ ID NO: 10569 - protein, 147 aa, Ureaplasma urealyticum serovar 10 ATCC 33699
MRKLALDLGTKSCGFAISDLLGIIASGLDNFIYEENDFIAVLAKIDEIMINYHHEIDTIVLGYPTNVYDGSKNKRTYLIESFYTLLKQHFLNHEKIKIVYEDERFSTKIATQRLKNSCVKAAKIKKVKDKMSAVVILESYLSKNHFN

SEQ ID NO: 10570 - protein, 141 aa, Dictyoglomus turgidum DSM 6724
MRVLAIDWGEKYIGLAISDPLRIIAQGLDVWEIKDEEDFVNRLKKLIKEYNVSEIVLGYPISLRGHENEKTKKIEYVAERIKTVVNLPIKFVDERFTTMEAERVLLEGDIKRRDRKLLKNKQAAVIILQKYLDSLSLDTKI

SEQ ID NO: 10571 - protein, 207 aa, Arthrobacter chlorophenolicus A6
MPSNGASPDMADPATAGGYPQGVKLGVDVGTVRVGVAICDRDSILATPYKTLDRNTKKNSDVRLIAKLAEELGAVQVIVGMPRTMKGEEHASARMASDYAGLLAAELAARGLDVPVNMVDERLSSVSAHRNLHEAGMSSRNHRKVVDQVAAAGILQHAIDMQKARGADVGSRVTAPSPSVDLGDSGTDESVRATPDTARFSDNGRQQ

SEQ ID NO: 10572 - protein, 138 aa, Acidimicrobium ferrooxidans DSM 10331
MSEGFGGRALGVDLGTKRIGVAVAEGSLALPLEVIDARGPWRARLAELVASVGASVVVVGLPIGLDGSEGRAAARVRQWSEGLAEHLEVPVVFVDERLSSQAAERRLGAAGVDARSRRGAVDAFAATEILERWLVTQR

SEQ ID NO: 10573 - protein, 170 aa, Actinosynnema mirum DSM 43827
MSSGDTPGVDDPGLGRRLGVDVGAVRVGVALSDPGAFLATPLVTLSRDEKNGRDLDDLVGLAAEHDVVEVVVGLPRTLAGKHGPAAQAATAYAAALAERVAPLPVRLTDERLTTVTASRVLAQRGVRGKKQRAVVDQAAAVEILQSWLDARARHVARAASERSPGAKDGS

SEQ ID NO: 10574 - protein, 163 aa, Beutenbergia cavernae DSM 12333
MRLGVDVGSVRVGVARCDPSGVIATPVTTLARRGKRGGVAEIAGLVREDSAIEVVIGLPRALDGHEGSSARQARAYAGQVARAVEPVPVRLVDERLSTVAAHRAMHEAGRAGRRHREVVDQAAAVVILQSALDAERATGAPPGEHVVPARPETGGTMTKEGSP

SEQ ID NO: 10575 - protein, 181 aa, Brachybacterium faecium DSM 4810
MSVAEGTGAEAGGLPRGVRLGVDVGDVRVGLARSDLDGMIATPVETLERGSAVARVVEEARELEARVIMVGLPRSLNGAEGAAAQKARDFAAELLTSLASGPTEIEVRMIDERLTTVTAHQALHRSGRKGRKHRSVVDQVAAVMILQQALDTERATGARAGERVEAAAAEHPPDPTEEDAR

SEQ ID NO: 10576 - protein, 189 aa, Micrococcus luteus NCTC 2665
MRSTPSSPRCARPEADVSAGQDGANAATDAVRRGRTLGVDVGRARVGVASADPDGLIATPVATLRRDARRRRDVDELVAHARELDVVAVYVGLPVNLRGEHTPSTQDALDYADAVAAALAEAGHPVPLRLVDERLSTVSAQAGLRAAGRSVKDSRGVIDQAAAVAILQAAVDEQRRTGRWAGQDREPIR

SEQ ID NO: 10577 - protein, 161 aa, Kytococcus sedentarius DSM 20547
MVWAVDVGLARVGVASGDPDGVLATPVETVAVAPGLTALDRVVQLVRQEERSTGVVVGLPRHLDGHESTSAVEARRWATALASRLGPTVRVWLVDERLSTVAASRGMREAGVRAKEQRTRIDQAAAVEILQMSLDAWRRGSRIGELVPGRKPRSRAAGRTP

SEQ ID NO: 10578 - protein, 138 aa, Eggerthella lenta DSM 2243
MRIMALDIGETRVGVAVSDPGERVASPVAVLPASEVLNCAKPFQRALEDWEPELLLCGLPYTMAGAEGPQAARIRKAAKTISDACGIPYEFADERLSSQEAKRSLREKGMTEKAMRGKIDMIAASLFLQAWLDARREA

SEQ ID NO: 10579 - protein, 171 aa, Catenulispora acidiphila DSM 44928
MEQPEVPDPSPRSEMRRGVRLGVDVGTVRIGVASCDRDGLLATPVETVKAEPRRASLDRLAALAAEYEAFEIVVGLPRSLSGGEGPAAAKIRAYARDLVRRLGPGTPVRLVDERLSTVTATQGLRASGVKAKKGRSVVDQAAAVVILQNALDAERMSGRPPGLMVQLEDGN

SEQ ID NO: 10580 - protein, 140 aa, Cryptobacterium curtum DSM 15641
MRVLSLDIGQVRCGIAISDPTGRVASPVCVLPSGEVIGCARSFKRLLDDWQPDLLLAGLPLTLSGSSGGQAQRIRAQAQQIADTSGLPLEFVDERLSSQEAKRMLREEGLTERDMRGKIDMIAASIFLQAWLDRQRAKKR

SEQ ID NO: 10581 - protein, 154 aa, Saccharomonospora viridis DSM 43017
MNDPGPGRRLAVDVGSVRVGVALSDPTPILASPLVTLSRDADTDKDLEELARLVAEHDVVEVIVGLPRTLADRHGTAAAIAADYARRLAERISPVAVRLADERLSTVSASRMLSQRGVKGRKQRAVVDQAAAVEFLQAWLDARAAAVAREAGQQ

SEQ ID NO: 10582 - protein, 167 aa, Jonesia denitrificans DSM 20603
MREFGRGVRLGVDVGQVRVGVAACDPDTILATPVETLARDRSVSYVAGGKVPSVLPTDIEDLREIAEERLAVAVYVGLPKHLSGARGVSAEMAVNYASLVQRVLPHLEVRLVDERLTSKTAHSALHDAGRRAREHRTVIDQAAAVVILDTALEAEKRLGSWAGESVE

SEQ ID NO: 10583 - protein, 138 aa, Slackia heliotrinireducens DSM 20476
MRVLALDIGEVRIGLAVSDAAGRIASPLKVLPADVVLNDGREFRMLVEDWEIEHLVCGLPYTMAGEEGPQAASIKEKARQIASARDLPLSFVDERLSSAEAKRILREEGLDERSMRGKVDMIAASLFLQAWLDSHDDQ

SEQ ID NO: 10584 - protein, 140 aa, Atopobium parvulum DSM 20469
MRVLALDIGEVRIGVAVSDPDGAIASPVCVLPAQEVLSHARTFKTVLEDWEPELLLCGRPKTLAGEDGPQAQKITVQAEQIAKNCQLPLEFTDERLSSAEAKKILRAQGLSEKAMRGKVDMVAASLFLQSWLDAQMNKGD

SEQ ID NO: 10585 - protein, 169 aa, Nakamurella multipartita DSM 44233
MTGTQQNPSGDAPAKGVRLGVDVGTVRVGVARSDPAGILATPVTTLQRSAAPSSGKSGDRAEPTADLSALRDLVVEHDVVEVVVGLPTTLRGMEGSAVTAARAYGQALAALIAPVPVVYVDERLTTVTADRVLAQAGIKGKARRAVVDQVAATRILQNRLDLLAAGRRS

SEQ ID NO: 10586 - protein, 88 aa, Brucella suis 1330
MKSMEYAPADLDEMIAREKKLVAIEYQNEAWADGMSEGIEPEILAEAAFTTALTELIREVGDDCALDLIEKMREQVIAGTFLSRRILQ

SEQ ID NO: 10587 - protein, 85 aa, Mesorhizobium BNC1
MHMTVADIEALIEEEKRTTCAECHSAAWAEGLLAGIEPEIIAEAALATALGELGKSGEEEKLLELLDTMRRRVLLGDFLPQQSRH

SEQ ID NO: 10588 - protein, 89 aa, Sinorhizobium medicae WSM419
MERMMEPSLTDIDDMIVHEKMQAALEHQNEAWADGMADGIEPEIIADAAIALAMRETVRLHGEEGAEAMLNSLRERMLAGEFSPERTIQ

SEQ ID NO: 10589 - protein, 85 aa, Ochrobactrum anthropi ATCC 49188
MEHAPADLDEMIAREKKLVAIEYHNEAWADGISEGIEPEILAEAAFTTALTELIREAGDDCALELIEKMREQIVAGTFLPQRILQ

SEQ ID NO: 10590 - protein, 85 aa, Rhizobium leguminosarum bv  trifolii WSM2304
MEASLNEIDDMIVHEKMQAALEYQNEAWADGMADGIEPEIIADAAIAHALRETIRLHGESSAEALLDSLRERMLAGEFSANRTLQ

SEQ ID NO: 10591 - protein, 85 aa, Agrobacterium vitis S4
MEPRRNEIDDMIVHEKMQAALEYQNEAWADGMADGIEPEIIADAAIALAMRETIRIHGEDGAEAMLESLRARMLAGEFSPKRSVQ

SEQ ID NO: 10592 - protein, 85 aa, Rhizobium leguminosarum bv  trifolii WSM1325
MEASLNDIDDMIVHEKMQAALEYQNEAWADGMADGIEPEIIADAAIAHALRETIRLHGEKSAEALLDSLRERMLAGDFSANRTLQ

SEQ ID NO: 10593 - protein, 97 aa, Ralstonia eutropha JMP134
MRTKKGRRRTPDSRLNIEMETDMLKLFIGLGIPYIGVIGMLPWVASVERFVLGVPFIYAWIFLWFVLTSGCMLACWWLFDRRADSLDTEVVPAADPC

SEQ ID NO: 10594 - protein, 69 aa, Burkholderia 383
MPKFLIGIAVPYLGVLGLLPWVSSVDAYVFGVPFIYAWMFAWFVLTSACLYVCWRCFDKPAADAARLDV

SEQ ID NO: 10595 - protein, 65 aa, Burkholderia 383
MLRYLIGIGIPYLGVIGVLPWVAAQDRYVLGVPFIFMWIFAWFVLTSGCLFACWMLFDRRASGAA

SEQ ID NO: 10596 - protein, 69 aa, Cupriavidus metallidurans CH34 uid250
MLKLLIGIGIPYVGVLGLLPWVASVDTFVLGVPFVYAWMFAWFVLTSVCLYVCWRFFDRPVDAERRLDA

SEQ ID NO: 10597 - protein, 68 aa, Delftia acidovorans SPH-1
MLKLFIGIGIPYIAVIGLLPWVASVDRHLLGVPFIYLWIFMWFVLTSLCMLVCWLMFDRHEADDVQSA

SEQ ID NO: 10598 - protein, 64 aa, Burkholderia multivorans ATCC 17616 JGI
MLRYLIGIGIPYLGVMGVLPWVASQDRYVFGVPFLFMWIFAWFVLTSGCLFACWMLFDRHTPGA

SEQ ID NO: 10599 - protein, 69 aa, Burkholderia phytofirmans PsJN
MLKLFIGLGIPYLGVVGLLPWVASVDRFVLGVPFIYAWIFAWFILTSGCLMICWRVFDCRHDESHPQNS

SEQ ID NO: 10600 - protein, 88 aa, Gluconacetobacter diazotrophicus PAl 5 JGI
MIDDPPADAAPVILPNGPSPVLPRWRLAVGIGIPFCAVDLALPWLDRVRGTILGFPVVTAWLFAWFVLTSACLGTVWVLHDRHLGDDD

SEQ ID NO: 10601 - protein, 174 aa, Rhodoferax ferrireducens T118
MTLIRPSQTEDIPAIAAIYARHVLHGTGTFEIDPPSPDDMAQRRVDVLAKGLPYLVAAKGDQVMGFAYCNWFKPRPAYRFSAEDSIYLADEAIGQGLGRALLAELMAQAEKAGVRKLIAVIGDSANHGSIGVHRSAGFSMVGVLKSCGWKFDQWLDVVMMDKALGLGATRAPQT

SEQ ID NO: 10602 - protein, 178 aa, Polaromonas JS666
MPLIRPSRDEDLPAITAIYGHHVLHGTGTFETEPPSLADMTARRADVLSKGLPYLVAEEDGRIAGFAYGNWFKPRPAYRYSVEDSIYLAPDLHRKGLGRALLTALLAHCEAVGIRKMMAIIGDSANAGSVGVHLALGFTQVGIVESCGWKFGAWRDIVIMQKTLGVGDTQPPTELPAP

SEQ ID NO: 10603 - protein, 197 aa, Acidovorax avenae citrulli AAC00-1
MRHATWPPGQRHAAKPAIISTSRRMPNIRPSRDEDLPAITAIYAHHVLHGTGTFETDPPSATDMAARRADVLARGLPYLVAEEQEEILGFAYANWFKPRPAYRFSAEDSIYVADAARGRGVGRLLLDALCGAAEAAGVRKLLAVIGDSANAGSVGVHRAAGFTEIGVMRSVGWKFGAWRDVVLMEKPLGAADTTAPE

SEQ ID NO: 10604 - protein, 173 aa, Acidovorax sp. JS42
MPLIRASRDEDVAAITAIYTHHVLHGTGTFEIDPPTALDMAARRADVLAKGLPYLVAEEAGQVLGFAYCNWFKPRPAYRFSAEDSIYIADAARGRGLGRQLLEALAVQAEAAGVRKLLAVIGDSANAGSIGVHRAAGFTDVGVMRSVGWKFGAWRDIVLMEKPLGAGDTTAPE

SEQ ID NO: 10605 - protein, 178 aa, Polaromonas naphthalenivorans CJ2
MPLIRPSRDEDIRAITAIYAHHVLHGTGTFETEPPGTSDMAARRADVQSKGLPYLVAEQDGKILGFAYGNWFKPRPAYRYSVEDSIYLAPDLQRKGLGRALLAELLARCEAAGIRKVMAIVGDSANAGSVGVHLALGFRQVGIIESCGWKFGAWRDIVIMQKTLGPGDTEPPSEPSAS

SEQ ID NO: 10606 - protein, 181 aa, Verminephrobacter eiseniae EF01-2
MTTIIRPGADDDIPAVTAIYRHHVLHGTGTFELDPPCATEMAARRADVLARGLPWLVAQEDGQILGFAYANWFKPRPAYRFSAEDSVYVADSARGRGLGRQLLAELVAQAQAAGVRKLLAVIGDSANAGSIGLHRALGFTDVGTMRSVGWKFGAWRDIVLMEKPLGAGDSTAPEGDGAAPG

SEQ ID NO: 10607 - protein, 190 aa, Methylibium petroleiphilum PM1
MSATYPAAALLLRPSAAADLPALTALYGWHARHGSGTFELEGPSLEEMARRRDDVLAKGLPWLVAERHGDLLGYAYAAPFRPRLAYRFALEDSIYLAPHAHRQGVGRALLAELIARCEAWGARQMFAVIGDSTNAASIGLHRALGFADVGTMHAAGWKFDRWLDVVIMQRRLGDGDATPPSDCPPAGGRS

SEQ ID NO: 10608 - protein, 174 aa, Delftia acidovorans SPH-1
MPTIRSSLDGDLAAITSIYRHHVLHGTGTFETDPPAESDMATRRADVLAKGLPYLVAVDEQGQVLGFAYANWFKPRPAYRFSAEDSIYVHDAARGQGLGRLLLDALSRECEAAGVRKLLAVIGDSANAGSIGVHRAAGFTPAGTLSSMGWKFGRWLDIVLMEKTLGDGNRSSPE

SEQ ID NO: 10609 - protein, 186 aa, Leptothrix cholodnii SP 6
MASFLIRPGVAADLPAITDIYAWNVEHGTGTFELEAPSQAEMAHRRDDVLSKGLPWLVAQRGDQVLGYAYANHFRPRPAFRFALEDSVYLAPAAQGQGLGTLLLAELLARCTAIGARQMFAVIGDSANAGSIGVHRRCGFAEVGVMRAAGWKFDRWLDVVIMQRSLGLGNQGSPQDYGPAAAGVAA

SEQ ID NO: 10610 - protein, 173 aa, Diaphorobacter TPSY uid29975
MPLIRASRDKDVAAITAIYTHHVLHGTGTFEIDPPTAQDMAARRADVLAKGLPYLVAEEAGQVLGFAYCNWFKPRPAYRFSAEDSIYVADAARGRGLGRQLLEALAMQAEAAGVRKLLAVIGDSANAGSIGVHRAAGFTDVGVMRSVGWKFGAWRDIVLMEKPLGAGDTTAPE

SEQ ID NO: 10611 - protein, 174 aa, Variovorax paradoxus S110
MTLTIRPSRDQDIAAITAIYAHHVLTGTGTFETEAPSAADMAARRADVLGKNLPYLVAEEDGEVLGFAYCNWFKPRPAYRFSAEDSIYMSEAARGKGLGAQLLAALSQAAEAVGVRKLIAVIGDSANAGSVGVHRSQGFTHVGVLKDCGWKFGQWRDVVLMEKVLGEGSTTQPE

SEQ ID NO: 10612 - protein, 91 aa, Dehalococcoides ethenogenes 195
MEKVTGKNAGEIKLYALSTCGWCRLTRQLLAELGVAYEFEYVDLLTGSERDKAVTELSALNPSKSFPTMLIGGSKVIIGYKEAEIREALKA

SEQ ID NO: 10613 - protein, 103 aa, Methanosarcina barkeri fusaro
MDVSTLNKEKGDHISGIDRGKVVMYGLSTCVWCKRTKKLLTDLGVDFDFIYVDRLEGKEENQAVEEVRHFNPSTSFPTTVINGEKAIVGFKEKEIREALGFQG

SEQ ID NO: 10614 - protein, 119 aa, Desulfovibrio desulfuricans G20
MGTQALPCACIVICSGRCYVAGDINPLRKGSTMAENSDVRLYALSTCIHCRKCKEFLEEHSVPFECVYVDMLSGDERSETISFIKKHNPKLSFPTLVIDNGGTVIVGFHKDQIEEALDL

SEQ ID NO: 10615 - protein, 79 aa, Methanospirillum hungatei JF-1
MLYALSTCIHCKQTRKLLDELKVAYDYLYVDQLSRSEMDEVLKEMEKVNPRGSFPTLVINNNKVIVGSRLDEIREALLS

SEQ ID NO: 10616 - protein, 93 aa, Methanosaeta thermophila PT
MGKVHVDGHDAGAVTLYALSTCMWCKKTRDLLSKLGVSYDYVYVDLTSGAERAELIDELRKFNPDLTFPTLVANGRVIIGFKEKEIMSALGAL

SEQ ID NO: 10617 - protein, 81 aa, Syntrophobacter fumaroxidans MPOB
MADCDVMLYALSTCIHCKNTKEYLDGCGVKYDCVEVDKLEGDERKNIIEEIKKVNPSCSFPTIIIGDKIIVGSGRKKSRRL

SEQ ID NO: 10618 - protein, 85 aa, Desulfovibrio vulgaris DP4
MSGCSVKLFALSTCVHCKNTRRFLEDHKVDVDCIYVDTLQGEERKQVVEEVKKHNPKLSFPTVVCANGKVIVGYREDELKEALSL

SEQ ID NO: 10619 - protein, 95 aa, Methanoculleus marisnigri JR1
MQRVPGVDRGRVVLYALSTCGWCARTKELLTDLGVGFSYVYVDLLAGEERDHVVREVERWNPQVSFPTVVIDEAKVIVGFREEEIREAVGARHSE

SEQ ID NO: 10620 - protein, 91 aa, Dehalococcoides BAV1
MEKIIGRNAGKIKLYALSTCGWCRLTRQLLAELGVAYEFEYVDLLTGAEREKAVKELTALNPSSSFPTMVIGENRVIIGYKESEIREALKA

SEQ ID NO: 10621 - protein, 92 aa, Candidatus Methanoregula boonei 6A8
MPTHVNGKNRGSVMLYALSTCQWCHKTKVLLEELGIAFDYEYVDLLEGGEQDRVMNAVEHWNPSGSFPTLVIDNKRAVVGFREHEIREALAV

SEQ ID NO: 10622 - protein, 85 aa, Candidatus Desulfococcus oleovorans Hxd3
MTQNDVMIYSLSTCSHCKSTKRLLNECSVAYDFVDVDLTTGDERKAILDDIKKINPNCTFPTIKINDRVIVGYKEQEIREALGIS

SEQ ID NO: 10623 - protein, 87 aa, Desulfovibrio vulgaris  Miyazaki F
MSDDSNEVKLFALSTCVHCKNTKQYLEEHGVDYKCVFVDQLEGDERKAVLEEIRAHNPKLSFPTLVCGNGRVIVGFHKEDIKEALHL

SEQ ID NO: 10624 - protein, 84 aa, Desulfomicrobium baculatum DSM 4028
MPDKAITLYALSTCIHCKKTKEYLDDCGAKYDCVFVDKLEGDERKQIIEAIKKINPKLSFPTLLVDEEAIVGFKQDQIKEALER

SEQ ID NO: 10625 - protein, 92 aa, Candidatus Methanosphaerula palustris E1 9c
MQIEVVDGRDKGNVMLYALSTCGWCAKTKELLKSLGVKYSYLYVDKVGPDEQEQVVKEIERFNPHLSFPTLVIGNDHVIVGFREDEIRKELA

SEQ ID NO: 10626 - protein, 84 aa, Desulfohalobium retbaense DSM 5692
MADITLYALSTCVHCKHTKEFLDECNVNYDCIYVDRLSGDERNDTIREIKKLNPNLSFPTLVIGDTIIVGYKKEDIEQALENHS

SEQ ID NO: 10627 - protein, 100 aa, Methanosarcina barkeri fusaro
MELAVIGKSEFVTGFRLAGVRKVYETADIAATESVVKSVLEDKSVGILVMHNDDIGNLPEMLRKNLNESVQPTVVALGGSGSGSNLRDKIKQAVGVDLWK

SEQ ID NO: 10628 - protein, 100 aa, Methanospirillum hungatei JF-1
MEIAVIGNSEFILGFRLAGITKTYAAESDEKVVEYVHKVLDDGKIGILVLNSSDMAKIPVRLRTTLENSVHPTVITLGEEEGGLSMRERIKRSVGVDLWK

SEQ ID NO: 10629 - protein, 99 aa, Methanococcoides burtonii DSM 6242
MELAVVGSSEFVTGFRLAGIKKIYEAKSDELESVVTKVLKDSDVGIFVIHEDDFNKLPEILRDTLSESVDPTVVTLGGTGESSNLREKIKQSVGVDLWK

SEQ ID NO: 10630 - protein, 99 aa, Methanosaeta thermophila PT
MEIAVIGNSDAVIGFSLAGIKKAYEATSEEELINKINEVMADPNVGILVLHQNDYNRLPKRLQSTLSNSVRPTVIAIGTEQSTEMREKIKRAIGVDLWK

SEQ ID NO: 10631 - protein, 100 aa, Methanocorpusculum labreanum Z
MEIAVIGNKEFVLGFQLAGIKKTYSAENPEKLAETITKVLDDTNVGILVLQSTDLEQIPRRLQVIIENSVKPTIVTIGGQEAGLSLRERIKRSVGVDLWK

SEQ ID NO: 10632 - protein, 100 aa, Methanoculleus marisnigri JR1
MEIAVVGTGEFILGFRLAGVRKTYAAETDERLVEHINQVLDDRDVGILVLKGSDMERIPLRLRTTLENSVKPTVIAIGGEEGGLSMRERIKRSVGVDLWK

SEQ ID NO: 10633 - protein, 99 aa, Methanococcus maripaludis C7
MRIGVVGDPDVVVGFRLAGLTDVYEVKSPEQAAKAIEELNSNSEIGLIITTERIGEEIRDTISGVKKVVVEVPDKNGPIVRENDPVKVLVRNAVGVDIK

SEQ ID NO: 10634 - protein, 100 aa, Candidatus Methanoregula boonei 6A8
MEIAVIGNSEFILGFRLAGIRKTYTAENDEKLLESVNSVLADGQVGILVLNSSDMERLPRRLRTTLENSVKPTVIALGGEEGGLSMRERIKRSVGVDLWK

SEQ ID NO: 10635 - protein, 109 aa, Halorubrum lacusprofundi ATCC 49239
MSQEIAVVGSPEFTTGFRLAGVRKFENIPDDEKDERLDDAVERTLDDEGTGIIVMHTDDLDHLSRGTREAVEGSIEPVLVTLGGSGAGSGGLRDQIKRAIGIDLMEEDD

SEQ ID NO: 10636 - protein, 107 aa, Halorhabdus utahensis DSM 12940
MSKEIAVIGSADFTTGFQLAGIRTFATISEDPETEEVDEAVTTMLEDDDVGIVVMHDPDLEHLSRSVRERVETSVDPVLVTLGGGAGSGGLRDQIKRAVGIDLMEED

SEQ ID NO: 10637 - protein, 100 aa, Candidatus Methanosphaerula palustris E1 9c
MEIAVIGNSEFILGFRLAGIRKTYAATDDERLHEHITSVLQDPEVGILVLNSTDMERLPRRLQSTLENSVRPTVIAIGGSEGDMSLREKIKRSVGVDLWK

SEQ ID NO: 10638 - protein, 107 aa, Halomicrobium mukohataei DSM 12286
MSQEIGVIGSPDFTTGFRLAGVRKFADVPDADKDEELDAAVEEMLDDEEIGIIVMHDDDLEHLSRGVRKDAETSVEPVMVTLGGGTGSGGLRDQIKRAIGIDLMEED

SEQ ID NO: 10639 - protein, 68 aa, Jannaschia CCS1
MPSGTVKWFNTTKGFGFIAPDDGGKDVFVHISAVERAGWSDLPDDTKLTYELREGRDGRESAVELVKV

SEQ ID NO: 10640 - protein, 68 aa, Ruegeria sp. TM1040
MPTGTVKWFNTTKGYGFIEPEEGGKDVFVHISAVERSGLTGLADNQKVGYELTEGRDGRQMAGDIRPL

SEQ ID NO: 10641 - protein, 68 aa, Rhodobacter sphaeroides 2 4 1
MPTGTVKWFNSTKGFGFIAPDDGGKDVFVHISAVERAGLKGLSDNQKIGYELQSGRDGRSSAGDLRLL

SEQ ID NO: 10642 - protein, 68 aa, Rhodobacter sphaeroides ATCC 17029; identical to SEQ ID NO: 10641

SEQ ID NO: 10643 - protein, 68 aa, Rhodobacter sphaeroides ATCC 17025; identical to SEQ ID NO: 10641

SEQ ID NO: 10644 - protein, 69 aa, Dinoroseobacter shibae DFL 12
MPTGTVKWFNTTKGYGFIAPDEGGKDVFVHISAVERAGLTGLADNTKIEYELREGRDGRSSATELKVVG

SEQ ID NO: 10645 - protein, 69 aa, Dickeya zeae Ech1591
MSKIKGSVKWFNESKGFGFITPEDGSKDVFVHFSAIQSNGFKTLAEGQRVEFEITSGAKGPSAANVIAI

SEQ ID NO: 10646 - protein, 130 aa, Rhodopseudomonas palustris HaA2
MTRIVIGIGFRAAAPQASIAEVIAAARGAAMPAQPTHLAVPDDKAVHPPLIAAATEAALPCLAISTAAIRSAADRIATDSPRVARARGVGSVCEAAALAAAGPAARLAVTRLISSDRQATAAVAIEEPPQ

SEQ ID NO: 10647 - protein, 126 aa, Novosphingobium aromaticivorans DSM 12444
MIIAGFGFRSGVGLPSLRAAFALAEQGQPPVTHLATAQDKLAALLPLAEALGLPLMGVASDALAAVSTPTRSIASLNARHVGSVAEASALAAAGAGARLLSPRHISPDRMATCAIAASVNLQGTPT

SEQ ID NO: 10648 - protein, 120 aa, Jannaschia CCS1
MIVAGFGFRAAATTASLADAFQRAGGRAEVFASAADKATSKVFIDFATGMDARVLGVTPDSLAAQRTLTQSHASQAARDTGSLAEAAALAAAGPGAKLLAPRVVSADRMATCALAEGDPI

SEQ ID NO: 10649 - protein, 129 aa, Rhodopseudomonas palustris BisB18
MSRLVIGLGFRNEAPAASIGEVLEAARAQAGGAADTIAVPDDKSVHAGLVNAALAAGLPIEPIAAEAMWDADADITTRSAASAKHRGVGSVCEAAALAAAGDGARLVVSRIVSADRSATAAAAISKEPT

SEQ ID NO: 10650 - protein, 130 aa, Rhodopseudomonas palustris BisB5
MTAVVIGVGFRSAARASSITDVIEAARRAIAPWRPTALATPADKADHAALLEAASAASLPVRPIDETALRQSAGLVATSSPLVVQHRGVGSVCEAAALAAAGPAARLLVPRLISQDRLATAAVAIEEPTP

SEQ ID NO: 10651 - protein, 120 aa, Ruegeria sp. TM1040
MIVAGFGFSNRASEASFAEAFAALDRRPDWVAVLRNKAKSPVFRAFALAEGLRVEPLEEYQISGAQTPTLSPRIHARFDTGSVAEACALVAAGKHARLIQRRFVTTDGLATVALAETIAR

SEQ ID NO: 10652 - protein, 124 aa, Rhodobacter sphaeroides 2 4 1
MIVAGLGFRESATEEELAAALGDEAPELLATLEARAALPAFQALARRLGLPVRALPEAALAGVATPTRSARIEERFGTGSIAEAAALVAAGPGATLMRTRRIAGPVTIAVARSAADPDRKGATA

SEQ ID NO: 10653 - protein, 116 aa, Paracoccus denitrificans PD1222
MRVAGIGFRQAASLASLADALARAGAAEALATSPAKVAAPAIRALAAQTGLPLLAVEVAGIATPTQSPRILARHGTGSLAEAAALAALGPGARIVASRVTSQDGMATAAIAEGDPA

SEQ ID NO: 10654 - protein, 124 aa, Rhodobacter sphaeroides ATCC 17029; identical to SEQ ID NO: 10652

SEQ ID NO: 10655 - protein, 126 aa, Rhodobacter sphaeroides ATCC 17025
MIVAGLGFRESATEEDLAAALALLGEMPEVLATLDARAALPALTALARRLGLPVVGLPEAALAGIATPTRSARIEQRFGTGSVAEAAALVAAGPGALLTRPRQIAGPVTIAVARAAAESDSKRATA

SEQ ID NO: 10656 - protein, 165 aa, Delftia acidovorans SPH-1
MNPDEAIPHRCGVLGLGLHTDALPHALQALWQRAQAQLPESADASACAPQPICAVAVLDTKAGHPALAAWMAAIVPTAVLVRVPPGQLPGQPVVTQSPRMLARYGTGSVAEAAALAAAGPHSALSVTRLVADDGSATLALAVGQGGPLNCCLAHASQAKKQGATA

SEQ ID NO: 10657 - protein, 130 aa, Rhodopseudomonas palustris TIE 1
MTTVVIGVGFRSAASASSIIDVIETARRAVAPHQLSALATAADKADHSGLSEAAAMTTLPVLPIDAAALDQAAARITTSSAVVAHHRGVGSVCEAAALAAAGPTARLIVSRLISQDRLATAAVAIEEPLP

SEQ ID NO: 10658 - protein, 122 aa, Methylobacterium chloromethanicum CM4
MSALVAGIGFRRGTPAAEIVALLGRALGEAASVKLWALATANRADEPARAFGLVALGVAPEALAAIDVRVPTRSPRIEQLRGVGSLAEAAVLAAAGVEARLILPRIASAGATCALARTEPRS

SEQ ID NO: 10659 - protein, 71 aa, Rhodospirillum rubrum ATCC 11170
MKVTIRKRPDGFEAYVAKKDMEEKIVAMEKEGLWGGWVKLANGWTFEMPDNDPETRLPITVEARKISGGED

SEQ ID NO: 10660 - protein, 71 aa, Rhodobacter sphaeroides 2 4 1
MKVMISEGAKGFVAYVAKKDLEEPVVAMEKPGMWGGWARLGNGWIFQMPAYDAPPALPITVEARRLTDREE

SEQ ID NO: 10661 - protein, 71 aa, Rhodobacter sphaeroides ATCC 17029
MKVMISEGAKGFVAYVAKKDLEEPVVAMEKPGMWGGWAKLGNGWIFQMPAYDAPPALPITVEARRLTDREE

SEQ ID NO: 10662 - protein, 71 aa, Rhodobacter sphaeroides ATCC 17025
MKVMISEGAKGFVAYVARKDLEEPVVATEKPGMWGGWARLGNGWIFQMPAYDTPPALPITVEARRLTDMED

SEQ ID NO: 10663 - protein, 70 aa, Bradyrhizobium BTAi1
MIRRSPETGLSIYVPKKDLEEPIVETEHETLWGGWIRIANGWVLELPQMAADTRLPITINARKRGGEGDE

SEQ ID NO: 10664 - protein, 71 aa, Xanthobacter autotrophicus Py2
MKIMIRRSPEMGLSIYVPKKDLEEPIVETEHETLWGGWIKIANGWVLDLPEMAEGTTLPITVNAKKRGEEE

SEQ ID NO: 10665 - protein, 72 aa, Methylobacterium sp. 4-46
MKLMIRRSPRGGLSAYAPKKDLEEPIVAMEHDALWGGWVRLKNGWTFVLPALPAETRLPITVNARKLGDEEE

SEQ ID NO: 10666 - protein, 71 aa, Gluconacetobacter diazotrophicus PAl 5 JGI
MKVMIRRDARGLSVYVPRKDLEEPVVAQQSEALWGGWVRLKNGWVLELPEMDAETRLPITVNARRLEGGAE

SEQ ID NO: 10667 - protein, 72 aa, Methylobacterium nodulans ORS 2060
MKLMIRKLPRGGLSAYAPKKDLEEPIVAMEREALWGGWVRLKNGWTFVLPALPADTRLPITVHAHKLGEEDE

SEQ ID NO: 10668 - protein, 300 aa, Methylococcus capsulatus Bath
MQQTGVVLEPARQRLAGIETRILDAVEYRPETRSLGRIVDLQPLLELRSRYRAAQAEAKITDAALRLARKNRDRLASLHSEAIVATRELIHAESQLAADEARAVTARQHVRELQEEGLQAWGTELFQAAVAGDSRLFDDLLQRRRVLLLVTLHHGQALPADAARIMVAREGDRQAAQPAELVSAAPKTDDIVQGETWFFHTDARKLRTGMRIEAWIPASAEKLSGVVIPRSAQIWHEGRPWVYLRIGADRFVRRPIDAHRDYGDAWFVDEGIEPGASLVTRGAQLLLSEEQRHAIPEEDD

SEQ ID NO: 10669 - protein, 354 aa, Burkholderia thailandensis E264
MKRRLLICSAVSVLLVAGAGWYAYRVYAPPAPAWPAATPAMPRSAVQTVDGETVVVVPPDEQRASRIEITQLAATTIRSERTAYATVIDLQPLFDLSNRLATALADRDSARELAATSRAQYARSRALYADDRNISQKALQDAQAAAQVARARLQSADATQGALAATMRQQYGAALTNAAMTPHSGLFQRLLTGQTVIVRVTLPSDDGDAAPERMTIDGPDGRPVPVRKLSASPQGDAAVQGMPWLYAAERMLPVGTRTSAHVPAPNGGASALVIPERAVVWYGGQPWAYVRTAPDRFTRRAVAADSAGGRGFVVTAGFHAGDSLVTQGAQLLLSEEQKPQGIATACKDPPECDD

SEQ ID NO: 10670 - protein, 314 aa, Bradyrhizobium BTAi1
MAYSTGPVLAQPEGREPATVKLSAAQQKQVGLQTAVLTAESHPEQFRAYGAVLDVARLTDLTNSYANAQAQLQTAQAKLEVARLAFDRARDLVQSAAMPKKDAEAAEGTFRTDQAALAAAESQVKTLMATARQEWGPVIGKGIVERSPQVVQLIEREQLLIQVTLPPGVSLAVPPRTALAQTPGRTANTDLLYLSPAPRTDARIQGVSYFFVAAGDSGLLPGMNTTAYVPSGKSFDGVFVEDTAIVQWQGRAWVYLRAGPETFKRHPIRTDQPVSDDDYVVQDIPPGSEIVLRGAQVLLSEEAKSELRGGGDDD

SEQ ID NO: 10671 - protein, 368 aa, Methylobacterium extorquens PA1
MRRVVLPVGLALGAGALGALTLTEAGIGLRVKAGPVLSDLHDRFSGVATPAAHQTPTAPSPPPSRVAVEGGQAVVRLTDAEQARIGVATARHKRMPHRIEVQAFGSVLDLARVTELTNSYASARAQLQTAEAKAEVSRAAYTRARSLGQYATQVQLETAEGTFRTDEAALAAAQSQVRTLAATAQQEWGTVIGRAIIERSPAITRLIERTDFLVQVTLPPGETLRAPPGTAHAEVPPQSERVALRYVSPATRTDQRIQGVSYFYTVAGNSGLLPGMSTLAFLTSERETTGIAVPESAVVHWQGGAWIYRSVGDDAFARHPLRADAPISADAYVVDDLGAEAEIVVTGPQAVLSEELKGQIQSSDADDD

SEQ ID NO: 10672 - protein, 369 aa, Methylobacterium radiotolerans JCM 2831
MSGRRALLLIGGILLAAAGLAVTPTGERLRADAGPLVAEVRARVAALIPARRDDTSTAAQLPAPRTAIEDGRTLVRLTPAERTRIGLVAEARPAILHRQELTAYGSVLDLARITELTNSYAGAVAALQTARARVEVSASAARRARTLGAGVVAVAQIETAEGTLLTDQASVTAAESQVRTLAATARQEWGPVLGKAIIERSPLVTRLIERTDFLVQVTLPPGETLPEAPRAAFAEVPPQSERVALRLVSPATRTDPRIQGQSFFYLVSGDSGLLPGTSTMAFLAAPRAVKGVLVPEDAVVHGEGGTWVYRGAGDGAFVRHPVRPDAPMAADAFVVEDLPDGSEIVLRGAQALLSEEMKSRIRVVGDDDD

SEQ ID NO: 10673 - protein, 368 aa, Methylobacterium populi BJ001
MRRRVVLPVGLALGVGVLGALMLTEAGNGLRVAAGPSLSDLHDRLSRATTPAAHQPAAQGRPSVRVAVEGGRAVVRLSDEERARIGVATARHVQASHRIEVQAFGSVLDLARVTELTNSYASAKAQLQTAEAKAGVSRAAFVRARSLGPYATQVQLETAEGTFRTDEAALAAAQSQVRTLAATAQQEWGTVIGRAIIERSAVITRLIERTDFLVQVTLPPGETLKAPPATASAEVPPQSERVALRYVSPATRTDQRIQGVSSFYTVAGDSGLLPGMSTLAFLTSERETTGIAVPESAVVHWQGNAWIYRSVGDDAFARHPLKADAPISADAYVVDDLGPEAEIVVTGPQAVLSEELKGQIQAADADDD

SEQ ID NO: 10674 - protein, 368 aa, Methylobacterium chloromethanicum CM4
MRRVVLPVGLALGAGALGALTLTEAGIGLRVKAGPVLSDLHDRFSGVATPAAHQPPTAPSPPPSRVAVEGGQAVVRLTDAEQARIGVATARHKRMPHRIEVQAFGSVLDLARVTELTNSYASARAQLQTAEAKAEVSRAAYTRARSLGQYATQVQLETAEGTFRTDEAALAAAQSQVRTLAATAQQEWGTVIGRAIIERSPAITRLIERTDFLVQVTLPPGETLRAPPGTAHAEVPPQSERVALRYVSPATRTDQRIQGVSYFYTVAGNSGLLPGMSTLAFLTSERETTGIAVPESAVVHWQGGAWIYRSVGDDAFARHPLRADAPISADAYVVDDLGAEAEIVVTGPQAVLSEELKGQIQSSDADDD

SEQ ID NO: 10675 - protein, 160 aa, Brucella suis 1330
MDRVKAIFQTARLALAGGFLLAAMAGAGAADRIAFVVPSATVYPGQIVSDTALLEKQFFINAPAATQYVLSLDQAVGKVARKTLLPGKPILVSALGEPSLVTRGIPAPLVFTAGTLTITAMGTPLESGVAGDFIKVRNVDSGIIVSGTVLANGRIQVGMQ

SEQ ID NO: 10676 - protein, 161 aa, Rhodopseudomonas palustris BisB18
MALMRAISTLVRRVWSAAFVATVISASALAEEPARFPVPATVIYPGDLIKDEMIIDRSFAPNLPGVAAFVGDRPAVVGRIARRTLLPGQLIPINALEEQKLVSRGSVVKVVVEDGSLSIVTYGSSLQAGSPGSMIQLRNLDTGVTIRGIVQPDGSVRIQNG

SEQ ID NO: 10677 - protein, 157 aa, Mesorhizobium BNC1
MRSGAGTRRIFLAGLLAALPLFAMPAHAQEVVVVPTRVIYPGETVSAEALQEMMLRQPPRGAASIARTPGDLEGKVARRTLLPGRLIPLSYVREPYLVEQGSTVTAVFTDGPLTISVLAVPLQPGAAGDFIKVRNVDSGAVFTGIVMQDGTVKVGAS

SEQ ID NO: 10678 - protein, 152 aa, Bartonella bacilliformis KC583
MKQLSLLLVNVFFSLCLLTAAYADRVSFLVPERSIYVGQRVSDVGLSEKNFIIKSEAASLYVIDMKQVLNKVATRPLRAGRPIALTALGDPVLVERGQTIKLIFQSDNLQITAIGVVLQSGSSGDVVRVRNADSGRIVMGTVLQNGSVRVGS

SEQ ID NO: 10679 - protein, 169 aa, Sinorhizobium medicae WSM419
MMFRRSAGGKAIAGGRARPVRAVLLAAVASCMLPPASALAEKPTAVIPKQTIYPGETLDASMLEVVDVTNPDLRDGYVRSLDEVDGMVTKRTLLPGRVILASALREQYAVERGSTVRIVFSNGGLTITAAGSPLQDGAIGELIRVRNIDTGVIVSGTVMADSTIHVVAK

SEQ ID NO: 10680 - protein, 160 aa, Ochrobactrum anthropi ATCC 49188
MGCVKAIFQKKRLVLAGGFLLAAMAGASAADRIAFVVPSATVYPGQIVSDTALLEKQFFINAPAATQYVLSPDQAAGKVARKTLLPGKPILVSALGEPSLVTRGVPAPLVFTAGTLTITAMGTPLESGAVGDFIKVRNVDSGIIVSGTVLANGRIQVGMQ

SEQ ID NO: 10681 - protein, 164 aa, Methylobacterium extorquens PA1
MPRKTFVRGLVLAALAAGSAQPIAPAQAVEGMANAELMLPVPTVTIYPGDTIKESMLRMQAYPATYRARTAVIDASAAIAGRVARRMLLPGEPVPVNAVDDPRLVSRGAPTQMIFEENGLVITAVGAPLQNGGLGETIRVRNTDTNRIILGTVMADGRIRIGAQ

SEQ ID NO: 10682 - protein, 142 aa, Methylobacterium radiotolerans JCM 2831
MATVMATGPAIAAEQMLPVPVATIYAGDVIKPTMLREQAFPEGYRPRLPVADTAARAVGRIARRTLLPGETIPSIALEEAKLVTRGAPAVIVFEEHGVTISTVGTALANAAVNEAVNVRNAATGRVVQGIVQPDGRVRTGQP

SEQ ID NO: 10683 - protein, 166 aa, Beijerinckia indica ATCC 9039
MHRKPWFLISSLRFLPLGVAACLSTLSAVHPVEASDALVLPVPTTTIYPGDTIKEAWIIEREFAANSTYARGNVLTERAALVGKAARRTLLPGVPIPINALSEPKAVLNGAKVRIVFMESGLTITAFGSALQSGSVGDNVSVRNLDSGLTVSGIVQADGSIRVSGS

SEQ ID NO: 10684 - protein, 162 aa, Methylobacterium populi BJ001
MLRKTFVRGLRAAALAAGLAAGPAHAVDGMANAELMLPVPTVTIYPGDTIKDSMLRMQAYPATYRARTAVIDASAAIAGRTARRMLLPGEPVPVNAVDDPRLVSRGAPTQMIFEENGLVITAVGAPLQNGGLGETIRVRNTDTNRIVLGTVTADGRIRIGAQ

SEQ ID NO: 10685 - protein, 176 aa, Methylobacterium sp. 4-46
MVMSSRTRRALALALLAGACGAGIGPCAAAPAAGPAAAQAPPERAPDLVLPVPAVTIYPGDMIKETMLREQSFPPTFRARAAVIDAPLAIVGRVARRTLLPGEPVPVNAVDDPRLVSRGTPTTMIFEENGLIITTLGTPLQNGGLGEVIRVRNTDTGRIVVGVVQGDGRIRIGDMR

SEQ ID NO: 10686 - protein, 160 aa, Rhizobium leguminosarum bv  trifolii WSM2304
MMFCRAGHISGWVAAATIAVAGIFLPADVDAGMGYAVVPTTIIYPGDTLSASQLQEVEVTNPNLSGDFAKTISQVEGLVSKRTLLPGRTISVSGLREPYTVTRGSSIRLVFSLGAMTISAAGSPLEDGATGQLIRARNMDSGVIVSGTVLADGTVHVRAK

SEQ ID NO: 10687 - protein, 148 aa, Methylocella silvestris BL2
MVGFVAICLFGRIPAHAAESHALPVPAITIYPGDPIKDEWLVDRDFGATSPLRGNVVTNRSAIIGKIARRTLLPGAPIPANVVAERKIVGNGTKVRIVFEQPGIEIATYGAALQDGALGDVISLRNIETGLTVTGVVQADGSVRVNGG

SEQ ID NO: 10688 - protein, 164 aa, Methylobacterium chloromethanicum CM4
MPRKTFVRGLVLASLAAGSAQPIAPAQAVEGMANAELMLPVPTVTIYPGDTIKESMLRMQAYPATYRARTAVIDASAAIAGRVARRMLLPGEPVPVNAVDDPRLVSRGAPTQMIFEENGLVITAVGAPLQNGGLGETIRVRNTDTNRIILGTVMADGRIRIGAQ

SEQ ID NO: 10689 - protein, 159 aa, Agrobacterium vitis S4
MMFRHMKRMFRLTGVAVMVLVAFAAAPSAARDRYAIVPTDTIYPGEAISSNKLDRVQVTNPNLAGGFASDMADVVGMLSTKTLLPGRTIPLATLKRPYAVIRGSQLRLIFNIGNLTISASGSPMDDANIGDVIRVRNLDSGQIVSGTVMGDGTVQVMAK

SEQ ID NO: 10690 - protein, 160 aa, Rhizobium leguminosarum bv  trifolii WSM1325
MMFCRAGHISGWVAAATIAVAGIFLPADVDAGMGYAVVPTTIIYPGDTLSSSQLQEVEVTNPNLAGDYAKSISQVEGMVSKRTLLPGRTISVSGLREAYTVTRGSSIRLVLSFGALTISAAGTPLEDGTTGQVVRARNMDSGVIVSGTVLADGTVHVRAK

SEQ ID NO: 10691 - protein, 56 aa, Nitrobacter winogradskyi Nb-255
MDSNDKPAGDRIVLTEAQKKRRRERSIAIACALGVLVLLFFAVTFIKGPGVLVRPV

SEQ ID NO: 10692 - protein, 52 aa, Rhodopseudomonas palustris HaA2
MDQQRPGIVLTEAQKKRQRERSIAIALALAVLVALFFAVTMVKGPIVLQRPM

SEQ ID NO: 10693 - protein, 59 aa, Rhodopseudomonas palustris BisB18
MIDSQRPNAPLIDGVVLTPAQKKSQRERSIAIALSLGVLVVLFFAVTMVKGAAVLVRPM

SEQ ID NO: 10694 - protein, 53 aa, Rhodopseudomonas palustris BisB5
MDQPRRPGIVLTEAQKKRQRERSIAIALALAVLVALFFAVTMVKGPIVLQRPM

SEQ ID NO: 10695 - protein, 54 aa, Nitrobacter hamburgensis X14
MDNKPKPDEIVLTEAQKKRRRERSIAIACALGILVVLFFAVTLVKGPGVIVRPM

SEQ ID NO: 10696 - protein, 65 aa, Maricaulis maris MCS10
MTQDNDLMNAREGKPTGETLKLTPEQEKARNKRNIVIAWSLVGFMVAVFAITVVRLSQNAAGAGV

SEQ ID NO: 10697 - protein, 58 aa, Bradyrhizobium BTAi1
MATAMADPNEPEGIVLTEAQLRSRRRRSIAIALALGVLVVLFFAVTMVKGPAVLKRPM

SEQ ID NO: 10698 - protein, 46 aa, Sinorhizobium medicae WSM419
METVQLSEAQKKSRRGRNIALGIVLACLVVIFYAVTLVKVGGGMVN

SEQ ID NO: 10699 - protein, 60 aa, Parvibaculum lavamentivorans DS-1
MSEQDESERHKVAAPQWTEEQLKRRRQRNLAIAWTLAGLMVLFFVVTIVKLGGNVVNRPL

SEQ ID NO: 10700 - protein, 61 aa, Xanthobacter autotrophicus Py2
MSKDKKTPRPSQEEGVVLTPEQLRRRRARNIAIASLLGFLAVLFYVVTIVKLGPNVLNRPL

SEQ ID NO: 10701 - protein, 54 aa, Methylobacterium extorquens PA1
MSDLPEGIRPLTPAEARTRRKRSVAIALTLGALVLLFFVLTIAKLGPQILQRPL

SEQ ID NO: 10702 - protein, 54 aa, Methylobacterium radiotolerans JCM 2831
MADPEIQYRPLTPEQEARRRKRSIAIALALGAWVLLFFVLTIVKLGPQILSRPI

SEQ ID NO: 10703 - protein, 55 aa, Beijerinckia indica ATCC 9039
MTEENKPEGIVLTPEQEKSRRQRNIAIGLAVAFFILLFYLVTIAKLGPGVLNRPL

SEQ ID NO: 10704 - protein, 54 aa, Methylobacterium populi BJ001
MSDLPEGVRPLTPEEAKTRRKRSIAIALTLGALVLLFFVLTIAKLGPQVLQRPL

SEQ ID NO: 10705 - protein, 55 aa, Rhodopseudomonas palustris TIE 1
MEPAHKTPPGIVLTDAQKKRQRERSIAIAVALGVLVVLFFAVTLVKGPAVLHRPM

SEQ ID NO: 10706 - protein, 50 aa, Methylobacterium sp. 4-46
MSDFPALTPEEARRRRKRSLAIALTLAALVAIFYVLTIAKLGPQVLNRPL

SEQ ID NO: 10707 - protein, 46 aa, Rhizobium leguminosarum bv  trifolii WSM2304
MDLVKLTEKQMKSRRNRNIALGLVLAGLVVLFYAITIVKIGGGMAG

SEQ ID NO: 10708 - protein, 58 aa, Methylocella silvestris BL2
MTDKAQTPVMTGVKLTPEQEKSRRQRNLALALAIGFFVVLFYVVTVVKLGPAVLERPF

SEQ ID NO: 10709 - protein, 54 aa, Methylobacterium chloromethanicum CM4; identical to SEQ ID NO: 10701

SEQ ID NO: 10710 - protein, 50 aa, Methylobacterium nodulans ORS 2060
MTDLPTLTPEEVRRRRKRSIAIALTLTALVAIFYVLTIAKLGPQVLNRPL

SEQ ID NO: 10711 - protein, 45 aa, Agrobacterium vitis S4
METVKLTEAQRKSRRGRNVALGLVLAGLVVLFYLVTLVKISGMGQ

SEQ ID NO: 10712 - protein, 46 aa, Rhizobium leguminosarum bv  trifolii WSM1325
MELVKLTEKQLKSRRNRNVALGLVLAGLVVLFYVMAIVKIGGGTAG

SEQ ID NO: 10713 - protein, 103 aa, Wolbachia endosymbiont of Drosophila melanogaster
MTLYNYTIIIVLMVLGLYIIINDKNLIKKMIGVSVFQASVLLFYISLGYIKSSLPPILVSNFYSYSNPIPHVLMLTAIVVGIATFSVGLSIAVKMEEKYGTID

SEQ ID NO: 10714 - protein, 270 aa, Thermobifida fusca YX
MNDTPTLLLVIVIGVLVTAGVTLLLERSLTRILLGVVLLGNGVNLLILSAGGAAGGPPLLSLTPEGEMADPLPQAMILTAIVITLGVTAFLLAMAYRSWQLQGNDEVQDDAEDRRIATGGERRRLRQYIRAQKRALRQAIRAQRMELEAQIEAQDELEEAERAILREQIAQARRDLDERLEAADDKDRERIIFQADHAQAAALDEAKRRVREARKELAEHRRADREYERRLRRELRQRIRAQKRQLRASIRAERERLARAEDSDMQGVDY

SEQ ID NO: 10715 - protein, 111 aa, Ehrlichia chaffeensis Arkansas
MILSCFNYIVSIILMVIGLYVTTANKNLVKKLIGLNIFQTSVLLFYISIGYVSDGNVPILNDKVILYTNPLPSVLMLTAIVVGVAILAVGLSIIVKIRRAFSSINNKEIRR

SEQ ID NO: 10716 - protein, 122 aa, Shewanella sediminis HAW-EB3
MVLGLYNYWIVVLLMMIGFYIVIAHGNLIKKLVGLTIFQTSVFIFYISMGNVDSGSAPILAEGVARYSNPLPHVLILTAIVVGIATTALGLALVVRIKESYGSIEEDEIQIQDQLTEDKTSC

SEQ ID NO: 10717 - protein, 120 aa, Shewanella pealeana ATCC 700345
MILGLYNYWIVVLLMMIGFYIVIAHGNLIKKLVGLTIFQTSVFIFYISMGNVDSGSAPILAEGVSRYSNPLPHVLILTAIVVGIATTALGLALVVRIKESYGSIEEDEIQIQDQLTEDKT

SEQ ID NO: 10718 - protein, 120 aa, Shewanella woodyi ATCC 51908
MFLGLYNYWIVVLLMMIGFYIVIAHGNLIKKLVGLTIFQTSVFIFYISVGMVERGSAPILAEGISDYSNPLPHVLILTAIVVGIATTALGLALAVRIKESYGSVEEDEIQRQDQLNEDKS

SEQ ID NO: 10719 - protein, 133 aa, Desulfohalobium retbaense DSM 5692
MDAILSTLLGKYNYWIYIALMMLGLWAIIAKNNLIKKIIGLNIFQTGIILFYISISAKKDATIPILMHHGGHGGHEAIHAVNYVNPLPQVLMLTAIVVSVATLGVALALSIRLYQRYKSLEEDEILTQLREEQ

SEQ ID NO: 10720 - protein, 110 aa, Ralstonia solanacearum
MTWSTRKMRRSGTWLAAALLGLASATAGARLPPPTAEQKARAEMDKAKAAWSDKVAAFQLCNAQDRAVAQYQASGKGTRTQAGAPCADPGPFVPPAPPAPATPATPAPKG

SEQ ID NO: 10721 - protein, 115 aa, Ralstonia eutropha JMP134
MKRILMLIALAAGTAGLAGSQAALAKLPSPTDAQKAKAEETKARTAWADKVAAFQLCKAQDKVAARYYGDMKTSGKGTHEPVQTAACADPGPFVPPAAPATPAAAAAVQSTAKAP

SEQ ID NO: 10722 - protein, 132 aa, Polaromonas JS666
MKKLIRLLTWGLLAGVPALALAKLPPLNDEAKAKAAEAAAKTAWTGKIEAYQLCKAQDKVVASYYKSAKSAGKETKPPAAAPACADPGAFAYTPPEAAKPIEAAGAHSPAPTATSPPSTKQPDAVANPAKKP

SEQ ID NO: 10723 - protein, 130 aa, Acidovorax sp. JS42
MIFAATLVRRCTAGLALASLAGVAAAKLPPLSPEAQAKAAETAAKAAWSGKMDAYKLCQAQDRVVAHYRRTAPNPAPAVPAPACLDPGPFSYTPPEAKPLEAAGAHSPAGTATSPPNTAVPAAAASAPKS

SEQ ID NO: 10724 - protein, 131 aa, Polaromonas naphthalenivorans CJ2
MTLKKLLTTGLLLGGCALAAARLPPPSPEAKAKSDEAAARAAWAGKVDAYQLCQSQDRAAASYFKSAQAAAKEVKPATATPPCTDPGVFAYTPAEAAKPLEASGAHSPAATATSPPGSKVPDAVMNPDKKP

SEQ ID NO: 10725 - protein, 142 aa, Methylibium petroleiphilum PM1
MLMMNRPTPGPRCVAAALCAVLGLALLPAAHAKLPAPTPEAKAKADEAKAKTAWSDKVAAFQLCKSMDRVAARYAQEAKAAGKETKPSIATPACTDPGPYQVAATAATPPLEAAGAHSPAKTATTPPSGKATSAEQTGTPKK

SEQ ID NO: 10726 - protein, 103 aa, Polynucleobacter necessarius asymbioticus QLW P1DMWA 1
MKKIIAFVFCAFAGTSVFATLPPLSPEAQEAANLVKAKTAYGDKVAAYQLCQAQNRVADKFRVSGTPAPAACVAPPPFVPPVAAASAPAAPAAPAAAPATAAK

SEQ ID NO: 10727 - protein, 117 aa, Leptothrix cholodnii SP 6
MNRYAILSAGLVGALFAATVSAKLPPPGDEAKAKAAEAAAKTAHGGKVEAWLLCKSMDRVAAAYLASAKQAGKDVRPPVATPPCADPGPFVYTPPAPVAAAASAPAVTAAAPAADKK

SEQ ID NO: 10728 - protein, 107 aa, Ralstonia pickettii 12J
MHASTLTRAAGMALAAAMLVLTSGLAGAKLPAPTEEQKAQADLAKAKAAWGDKVAAFQTCKAQDKAAASYQAGGKAAHTQPGAPCVDPGPFVAPVPAASAPAPAAKG

SEQ ID NO: 10729 - protein, 130 aa, Diaphorobacter TPSY uid29975
MIFAATLVRRCTAGLALASLAGVAAAKLPPLSPEAQAKAAETAAKAAWSGKVDAYKLCQAQDRVVAHYRRTAPNAAPAVSAPACLDPGPFSYTPPEAKPLEAAGAHSPAGTATSPPNTAVPAAAASAPKS

SEQ ID NO: 10730 - protein, 137 aa, Variovorax paradoxus S110
MKLPLNLSCASLLVLALAAPAAWAKLAPPPATPEAKAKAAEAAAKTAWSGKVDAYKLCQAQDRVAAKYRASATAAGKPVPPAPATPPCADPGPFVFTPPAEAKPIEAAGAHSPATTAASPPSTTQPAAAANPTPKAQ

SEQ ID NO: 10731 - protein, 107 aa, Ralstonia pickettii 12D
MHAFTLTRAAGMALAAAMLGLTSGLAGAKLPAPTEEQKAQADLAKAKAAWGDKVAAFQTCKAQDKAAASYQAGGKAAHTQPGAPCVDPGPFVAPVPAAPAAAPAAKG

SEQ ID NO: 10732 - protein, 73 aa, Methanosarcina barkeri fusaro
MADENITGGFAAEVIDVIGNTGMHGEASQIQCRVLEGRDKGRVITRNCVGPVRVGDILMLLETSREAKKLTTR

SEQ ID NO: 10733 - protein, 67 aa, Methanospirillum hungatei JF-1
MDGTPAEVIEVIGSTGMHGEAMQVKARILDGPNKGRIITRNTVGPIREGDVLMLLETEREAKKLSRR

SEQ ID NO: 10734 - protein, 71 aa, Methanococcoides burtonii DSM 6242
MADDDMGFAAEVIDVIGNTGMHGEASQIQCRVLEGRDKGRIITRNCVGPVRIGDVFMLMETSREAKKLTTR

SEQ ID NO: 10735 - protein, 70 aa, Methanosaeta thermophila PT
MVEENGVPAEVIEVIGVTGMHGEATQIKCRILEGSNKGRIITRNCMGPVRVGDVLMLLETAREAKKLTGR

SEQ ID NO: 10736 - protein, 77 aa, Pyrobaculum islandicum DSM 4184
MSSEVKFSPYEDAVAALVIQILGRTGVAGEVTQVKVKILEGRDKGRILTRNIKGPVRLGDIVMLRETEREARRITAR

SEQ ID NO: 10737 - protein, 69 aa, Methanocorpusculum labreanum Z
MPDDATPAEVIEVIGLTGMHGEASQIKCRVLDGSNKGRIITRNTFGPIREGDILMLLETEREAKKLSRR

SEQ ID NO: 10738 - protein, 69 aa, Methanoculleus marisnigri JR1
MANDGTPAEVIEIIGMTGMHGEAQQVKCRVLDGPNKGRIITRNTVGPIREGDILSLLETEREAKKLSRR

SEQ ID NO: 10739 - protein, 76 aa, Methanococcus maripaludis C5
MADDMVYQEAVAAEVIQINGRTGVTGEIFQVRCKILGGKDTGRILTRNVKGPVKLGDLIMLRETEREAKQLGKRRK

SEQ ID NO: 10740 - protein, 77 aa, Pyrobaculum arsenaticum DSM 13514
MAEEVKFSPYEDAVAGIVIQILGRTGIAGEVTQVKVKILEGRDKGRVLTRNIKGPVRLGDIVMLRETEREARRISAR

SEQ ID NO: 10741 - protein, 80 aa, Metallosphaera sedula DSM 5348
MSEKQQSSSIIEEFGFPAEVIQLLDRTGVTGEVTQVRVRVLEGRDKGRILTRNIKGPVRLGDIVILRETEREARKLTTKR

SEQ ID NO: 10742 - protein, 76 aa, Methanococcus vannielii SB
MADDMVYQEAVAAEVIQVSGRTGVTGEIFQVRCKILGGKDTGRILTRNVKGPVKVGDLIMLRETEREAKQLGKRRK

SEQ ID NO: 10743 - protein, 75 aa, Methanococcus aeolicus Nankai-3
MSDDMIYKEAIAAEVLQVTGRTGVTGEIFQVRCKILGGKDTGRILTRNIKGPIKVGDIIMLRETEREAKALGRRR

SEQ ID NO: 10744 - protein, 76 aa, Methanococcus maripaludis C7
MADDMVYQEAVAAEVIQINGRTGVTGEIFQVRCKILGGKDTGRILTRNVKGPVKLGDFIMLRETEREAKQLGKRRK

SEQ ID NO: 10745 - protein, 69 aa, Candidatus Methanoregula boonei 6A8
MADDATPAEVIEVVGSTGMHGEAMQVKCRILDGNNKGRIITRNTVGPIREGDVIMLLETEREAKKLSRR

SEQ ID NO: 10746 - protein, 76 aa, Methanococcus maripaludis C6; identical to SEQ ID NO: 10744

SEQ ID NO: 10747 - protein, 70 aa, Nitrosopumilus maritimus SCM1
MSATTDEVVHSEIIQIVGRTGIAGEVIQVRVKVLTGKDKGRILTRNVKGSVRLGEILMLRETEREAKKIK

SEQ ID NO: 10748 - protein, 77 aa, Thermoproteus neutrophilus V24Sta
MAEEVKFSPYEDAVAGLVVQILGRTGVAGEVTQVKIKVLEGRDKGRVLTRNVKGPVRLGDIVMLRETEREARRITAR

SEQ ID NO: 10749 - protein, 74 aa, Halorubrum lacusprofundi ATCC 49239
MSAEEGTGDSTTAEVIEVVGKTGMHGEAMQVKCRIQEGSNQGRIITRNVLGPVRMGDVLQLRETQRDADSIGGR

SEQ ID NO: 10750 - protein, 75 aa, Halorhabdus utahensis DSM 12940
MSAEESTDDGSTPAEVIEVVGRTGMHGEAMQVKCRIREGENKGRIITRNVLGGVREGDVLQLRETAREADAIGGQ

SEQ ID NO: 10751 - protein, 69 aa, Candidatus Methanosphaerula palustris E1 9c
MADEGTPAEVIEVIGSTGMHGEAMQVKCRILDGSNKGRIITRNTVGPIREGDILMLLETEREAKKLSRR

SEQ ID NO: 10752 - protein, 75 aa, Halomicrobium mukohataei DSM 12286
MSAEESEDSGSTPAEVIEVVGRTGMHGEAMQVKCRIREGSNQGRIITRNVLGPVREGDVLQLRETAREADQIGGQ

SEQ ID NO: 10753 - protein, 66 aa, Brucella suis 1330
MSDIVNLRQFKKQKARDTKEKQAEQNRILFGRTKVEKDFARAQAQKAERFLDMNRRETKDLPEGEK

SEQ ID NO: 10754 - protein, 64 aa, Nitrobacter winogradskyi Nb-255
MVMGDVINLNKRRKRAERERAAAVADANRARFGLTKAERDLSKQRKARELSLLDQHRIDGEDAS

SEQ ID NO: 10755 - protein, 62 aa, Rhodopseudomonas palustris HaA2
MVDVVNLRRFKKRAEREAAAKLADVNRARFGRTKSQRASDEHRVGRANELLDQHVIGGEDAS

SEQ ID NO: 10756 - protein, 61 aa, Rhodopseudomonas palustris BisB18
MADVINLKRFKKRTARAQSAAEADANRARFGRTKAERALDERRTSRADELLDQHRTTGDLT

SEQ ID NO: 10757 - protein, 62 aa, Rhodopseudomonas palustris BisB5
MADLVNLKRFKKRAEREAAAKHADVNRARFGRTKSQRAIDDHRVSRANELLDQHIIGGEDAS

SEQ ID NO: 10758 - protein, 67 aa, Nitrobacter hamburgensis X14
MAESVMGDVVNLSKRRKRAERERTAEIADANRARFGRPKAERDLIEQRMMREKRLLDQHRIDGEDGS

SEQ ID NO: 10759 - protein, 67 aa, Rhodobacter sphaeroides 2 4 1
MAEIVNLRAKRKAAERDARRRKGDENAAKHGRTRAERRLEETRAEQARAHLEGHRRETDAPDEPTDP

SEQ ID NO: 10760 - protein, 69 aa, Paracoccus denitrificans PD1222
MTGAGSGKVINLRAARKTAARDAARKQGDENAAKFGRNKSQKLAEKDAAARAARHLDQHRREDPENGDE

SEQ ID NO: 10761 - protein, 67 aa, Rhodobacter sphaeroides ATCC 17029
MAEIVNLRARRKAAERDARRRKGDENAAKHGRIKAARRLEETRAEQARAHLEGHRRETDAPDEPTDP

SEQ ID NO: 10762 - protein, 67 aa, Rhodobacter sphaeroides ATCC 17025
MAEIVNLRAKRKAAERDARRRKGDENAAKFGRTKAERDLPEARAEKARDHLDAHRRESGREPGPEPE

SEQ ID NO: 10763 - protein, 61 aa, Bradyrhizobium BTAi1
MGDVINLKRFKKRVERDQAAQAADTNRARYGRTKSERATDAQRDKRANELLDQHRINGEDA

SEQ ID NO: 10764 - protein, 86 aa, Brucella ovis
MRKRDDARNIAQICHNTVTLMSDIVNLRQFKKQKARDTKEKQAEQNRILFGRTKVEKDFARAQAQKAERFLDMNRRETKDLPEGEK

SEQ ID NO: 10765 - protein, 71 aa, Sinorhizobium medicae WSM419
MTGDVTNLRQFRKRQARTAREKQAEQNRLTFGRTKAEKSVTKALNEKTAKTLDHGRLDRAGDDGAPDRNKP

SEQ ID NO: 10766 - protein, 66 aa, Ochrobactrum anthropi ATCC 49188
MSDIVNLRQFKKQKARAEKEKQADQNRIQFGRTKTEKAFARTETTKAERFLDQNRLEKNDKPDGTK

SEQ ID NO: 10767 - protein, 62 aa, Methylobacterium extorquens PA1
MAEIINLRQVRKDREKAAKEVKAAENRILFGRPKKAKTLAETRKAIEQSRHEGHRLADPDNE

SEQ ID NO: 10768 - protein, 67 aa, Methylobacterium radiotolerans JCM 2831
MAEIINLRQVRKAKARAEADTKAESNRIAFGQPKKAKTLQQRRKALETERHEGHRLERGASEPDTAE

SEQ ID NO: 10769 - protein, 69 aa, Beijerinckia indica ATCC 9039
MGELVNLRRARKDKARQAKDERAAANRLLHGRTRAEREKLDAEKGLAERRLDAHLLLKDQEKGTSDSSS

SEQ ID NO: 10770 - protein, 62 aa, Methylobacterium populi BJ001
MAEIINLRQVRKAREKAAKETKAAENRILFGRPKKAKTLAETRKALEQARHEGHRLTDPDKE

SEQ ID NO: 10771 - protein, 62 aa, Rhodopseudomonas palustris TIE 1
MADVVNLKRFKKRAEREAAAKLADANRARFGRTKSQRGLDQHHVSRANQLLDQHIIGGEDAS

SEQ ID NO: 10772 - protein, 71 aa, Methylobacterium sp. 4-46
MAEIINLRRARKARARQTEEARAEENRVAFGRPKAARTLAESRRAIETARHEGHRLEGPPEDRPGVTDPSE

SEQ ID NO: 10773 - protein, 64 aa, Rhizobium leguminosarum bv  trifolii WSM2304
MSAEIVNLRQFRKKQARSEKETQAEQNRISFGRTKAEKQLTRSLNEKADKAHRDGRIETDDDGA

SEQ ID NO: 10774 - protein, 94 aa, Methylocella silvestris BL2
MPNIVNLRLFRKRRAREDAADAAEHARVRAGLAKTERSAAERLCAQAKLRLDGHLLEHLSLEPVRSDGGDPTKVVCSRSIGARTTGPADDAAAR

SEQ ID NO: 10775 - protein, 62 aa, Methylobacterium chloromethanicum CM4
MAEIINLRQVRKDREKVAKEAKAAENRILFGRPKKAKTLAETRKAIEQSRHEGHRLADPDKE

SEQ ID NO: 10776 - protein, 63 aa, Methylobacterium nodulans ORS 2060
MAEIVNLRQARKAKARQAKEAAAAENRAAFGRPRKTRTLAEARQAIETARHEGHRLEGSGPSE

SEQ ID NO: 10777 - protein, 70 aa, Agrobacterium vitis S4
MSGEVVNLRQVRKAKARTEKEKIADQNRVSFGRSKAEKNLTSALNDKARAALDNSKLEPTPTSPVPDEQG

SEQ ID NO: 10778 - protein, 64 aa, Rhizobium leguminosarum bv  trifolii WSM1325
MSAEIINLRQFRKKQARSEQEKQAEQNRISFGRTKGEKQLTRSLNDKADKAHRDGRIETDDDGA

SEQ ID NO: 10779 - protein, 184 aa, Rhodopseudomonas palustris BisB18
MKIIPTPLAGCVLIEPDIIADERGYFLRTFCASTFEAHGLNPAIDQASLSYNRAQYTLRGLHFQAQPHMEDKLVRVVNGAIFDVAVDIRTDSKTFARWYAAELTEQNQRALYIPRGFAHGFLTLTDETTVAYQIAQPYVASLARGVNFSDPQIAVRWPHPPSVISQRDRDLPALAAIDPTSVSQ

SEQ ID NO: 10780 - protein, 187 aa, Pelobacter propionicus DSM 2379
MTFIHTRISGCLEIVPVCFQDERGRFVKTYNEKTFESHGCCTDWKEEFYSVSRRGVLRGLHFQLPPHQHDKLVYCTAGTVLDAVVDLRKGSPTYGDHIMLELSAEKGNMLYIPRGLAHGFYVTSESATMMYKVSSVYAPDHDAGIRWDSAGIAWPASTPIISTKDGLLPPLIDFSSPFSFDDCAKRQ

SEQ ID NO: 10781 - protein, 185 aa, Prochlorococcus marinus MIT 9515
MKISETPIAGAYILENDVYRDNRGSFTCFYIEDDFKKNNLNTKWTQINSSLSFDERTLRGIHFQYPPYSQIKLVRVIQGSIFDVIVDLRPKSKTFGKHFFYFLNEKNNKMLYIANGFGHGFMTMENNTKIIYNVSAPYKPEYEETIIWNDKLLNIQWPNSPLKLSAKDLNGKTFNEIKLEILNRV

SEQ ID NO: 10782 - protein, 193 aa, Methanocorpusculum labreanum Z
MGKLTIIETPLKGLYIVETNAFIDHRGAFARWFCEEELAAVLGKRHIKNVNFSRTVKKGSIRGMHFQKPPHAEMKLVRCIRGRILDVVVDIRAGSPTFLQHYSVELSAENMKMFAVPEGFAHGFQSLEDDSEIMYLVTEFYSPESEAGLRFSDPALKIEWPLPVMDISEKDGKHPLVNDNFVGFDVSMYGEQV

SEQ ID NO: 10783 - protein, 177 aa, Methylobacterium extorquens PA1
MIFEELALPGLFRVVPEPHADERGFFARTQCESEFAERGLVGHFTQSSVSFNHRRGTVRGMHFSKLPHAETKLVRCTAGAIHDAVIDLRPDSPTYLRTTSVTLSAANRHALYIPAGLAHGFQTLSDDAEILYMIDRPFVASAADGVRWDDPAFGLVWPEPVTVIAPRDLAFPDWAGR

SEQ ID NO: 10784 - protein, 177 aa, Methylobacterium populi BJ001
MIFEELALPGLFRVAPEPHADERGFFARTHCEETFTARGLVGRFAQSSVSFNHRRGTVRGMHFSRAPHAETKLVRCTAGAIHDAVIDLRPDSPTYRRTAAVRLSAANRHALYIPAGLAHGFQTLSDDAEILYMIDLPFVASAADGVRWDDPAFALTWPEPVSVISDRDRAFPDWVGR

SEQ ID NO: 10785 - protein, 176 aa, Cyanothece PCC 8801
MKFISTKLNGAYLIELKRLEDERGFFARSWCQKEFLDYGLDANLVQCNISFNLKKGTLRGMHYQIAPYEEVKLLRCTQGAIYDVIIDLNLESSSFKQWIGVELSAENRLMIYIPKGFAHGFQTLEDHTEVFYQMSEFYHPECARGVRWNDPTFAIEWPIEDPIISEKDRQYEDFKG

SEQ ID NO: 10786 - protein, 177 aa, Methylobacterium chloromethanicum CM4
MIFEELALPSLFRVVPEPHADERGFFARTQCESEFAERGLVGHFTQSSVSFNHRRGTVRGMHFSKLPHAETKLVRCTGGAIHDAVIDLRPDSPTYLRTASVTLSAANRHALYIPAGLAHGFQTLSDDAEILYMIDRPFVASAADGVRWDDPAFGLAWPEPVTVIAPRDLAFPDWTGR

SEQ ID NO: 10787 - protein, 175 aa, Desulfomicrobium baculatum DSM 4028
MRILPTPIGGLHQIEGEAHRDARGFFLRTWCREAFLAAGIDFFPVQTSLSANIRRHTLRGMHYQVSPARERKLVRCLHGRILDVVVDLRDGSPTRLRHWAVNLCSDAGNALFIPEGCAHGFMTLTDGALVEYMMDAPHAPEHARGLRWDDPALGLSWPARPVVISLRDRSWPGHV

SEQ ID NO: 10788 - protein, 176 aa, Cyanothece PCC 8802
MKFISTKLNGAYLIELKRLEDERGFFARSWCQKEFLDYGLDANLVQCNISFNLKKGTLRGMHYQIAPYEEVKLLRCTQGAIYDVIIDLNPNSSSFKQWIGVELSAENRLMIYIPKGFAHGFQTLEDHTEVFYQMSEFYHPECARGVRWNDPTFAIEWPIEDSIISEKDRQYEDFKG

SEQ ID NO: 10789 - protein, 91 aa, Jannaschia CCS1
MSEPREIRLKRLRLRAWHRGIKEMDLILGGWADRNLSDATDADLDAFEAVMAEADHDLYQWISGQAEAPSELSAMVDRIGADMRPTLGRGA

SEQ ID NO: 10790 - protein, 92 aa, Ruegeria sp. TM1040
MIEAQANIEESRETRIKRLTMRSMRRGIKEMDILLSGYAAANLAAMSDAQLALYDALLRENDQDLYQWVTGQTPAPERFNALVDEISRTYQK

SEQ ID NO: 10791 - protein, 89 aa, Rhodobacter sphaeroides 2 4 1
MIEAEDARLKRMSMRSWRRGTKEMDLILGPWSDAHLAGLSEERLALYDSLLNENDQDLLPWVLGQREPPAHLAALIAEIGAFARSRLAR

SEQ ID NO: 10792 - protein, 81 aa, Paracoccus denitrificans PD1222
MRSWRRGTKEMDLILGPFSDSELERLTEAELDLYEALLTENDQDLYPWITARLGDARPGPQALLPILDRVASFAHARLARK

SEQ ID NO: 10793 - protein, 89 aa, Rhodobacter sphaeroides ATCC 17029
MIEAEDARLKRMSMRSWRRGTKEMDLILGPWSDAHLAGLSEERLALYDSLLNENDQDLLPWVLGQREPPAHLAALIAEIGAFARTRLAR

SEQ ID NO: 10794 - protein, 89 aa, Rhodobacter sphaeroides ATCC 17025
MIEADEARLKRMSMRSWRRGTKEMDLILGPWSDAHLAHLSEERLALYDSLLNENDQDLLPWILGQREPPAPLAALISEIGEFARTRLAR

SEQ ID NO: 10795 - protein, 99 aa, Dinoroseobacter shibae DFL 12
MSEFHLTEAAMGVVTPNETPEARIKRMKIRAWRRGIKEMDLILGPYADTHLAGMSEAELDAFDALLKENDQDLYQWVSGQAAPPERFAALVTRLGQTGR

SEQ ID NO: 10796 - protein, 57 aa, Brucella suis 1330
MSNHLGFIIASYGITVAALAVTIGWILIDQRIQKNELKRLEAQGVRRRSAKAPGKAQ

SEQ ID NO: 10797 - protein, 59 aa, Nitrobacter winogradskyi Nb-255
MALGPYASFIVTSYVSVAAVVVALIVWVIMDYRRQKARLRGLEAAGAVRRSGRSAAEVQ

SEQ ID NO: 10798 - protein, 60 aa, Rhodopseudomonas palustris BisB18
MMSLGPYASFIVLSYAVSALVVAILIVWVALDYRRQQAKLRALDAAGVSRRSKRNAAEAS

SEQ ID NO: 10799 - protein, 59 aa, Rhodopseudomonas palustris BisB5
MMFGRYAEFIVSSYAATAIVVVLLILWVVIDYRRQKARLRDLEARGAVRRSGRSATDLS

SEQ ID NO: 10800 - protein, 59 aa, Nitrobacter hamburgensis X14
MTLGPYASFIVMSYVAVAAVVVALVIWVIVDYRRQKARLRDLEAAGAVRRSGRSAAEIK

SEQ ID NO: 10801 - protein, 53 aa, Mesorhizobium BNC1
MTHLAYVAAAYAIAALAILGLVGWILLDQSAQRRALKELEARGIRRRSTGNSK

SEQ ID NO: 10802 - protein, 59 aa, Bradyrhizobium BTAi1
MDLGPYTSFIATSYLAAALVVVLLIAWIAIDYRTQKARLRALEESGIVRRSGRAATDIQ

SEQ ID NO: 10803 - protein, 57 aa, Brucella ovis; identical to SEQ ID NO: 10796

SEQ ID NO: 10804 - protein, 58 aa, Sinorhizobium medicae WSM419
MMSHATYVIACYAVSAATVAGLIFWVLTDGRARKRELEQLEAAGIRRRSAEASTGGGR

SEQ ID NO: 10805 - protein, 56 aa, Ochrobactrum anthropi ATCC 49188
MNHLGYVLASYGITVAALAVTIGWILIDQRIHKNELKRLEAQGVRRRSAKASGKAQ

SEQ ID NO: 10806 - protein, 57 aa, Rhodopseudomonas palustris TIE 1
MFGKYADFIVSSYAATAIVVLLLIGWVVLDYRKQKARLRDLEARGAVRRSGRSAIDH

SEQ ID NO: 10807 - protein, 55 aa, Rhizobium leguminosarum bv  trifolii WSM2304
MTHAFYVYASYGFAAFMTVAVTLWTWADGRARRRELAALEAAGIRRRSARKRDSE

SEQ ID NO: 10808 - protein, 56 aa, Agrobacterium vitis S4
MKYAFYIGTAYGLTAAAILFMVFWIWLEGRARQKELKALEAAGIRRRSDPSTEKAL

SEQ ID NO: 10809 - protein, 59 aa, Rhizobium leguminosarum bv  trifolii WSM1325
MTHAFYVYASYGFAALVTIAVTAWTWADGRARRRELAALEAAGIRRRSARPKDSVGDGE

SEQ ID NO: 10810 - protein, 231 aa, Pseudomonas putida KT2440
MSQSATLLVIDDEPQIRKFLRISLASQGYKVLEAATGAEGLAQAALGKPDLVVLDLGLPDMDGQQVLRELREWSAVPVMVLSVRASEVQKVDALDGGANDYVTKPFGIQEFLARVRALLRQVPQAGGSEVAASFGPLTVDFAFRRVTLDGVEVALTRKEYALLAILAGHPGRVITQQQLLKDIWGPTHAEDTHYLRIVVGHLRQKLGDDPTAPRFIITEAGVGYRLVAPTA

SEQ ID NO: 10811 - protein, 230 aa, Pseudomonas syringae tomato DC3000
MSQTATILVIDDEPQIRKFLRISLVSQGYKVLEAATGTEGLTQAALNKPDLLVLDLGLPDMDGQQVLSEFREWSAVPVLVLSVRASEAQKVQALDAGANDYVTKPFGIQEFLARVRALLRQVSGSDKPESALRFGPLTVDLAYRRVLLDDLEVALTRKEYSVLAQLARYPGRVITQQQLLKDIWGPTHAEDSHYLRIVVGHLRQKLGDDPTAPRFIITEAGIGYRLLADS

SEQ ID NO: 10812 - protein, 234 aa, Geobacter sulfurreducens
MGHEANAINRPRILIVDDEAAIRRFLRTVLDAEEFSLHQAETGHAALAAAAAIRPDLILLDLGLPDLDGVEVIRRIREWSPVPIIVLSVREREDDKVHALDAGADDYLTKPFGIGELLARMRVVLRRSIRQAPEPICRIGGLEVDLPRRRVTVDGVEVQLTPTEYELLRLLAVHAGKVLTHSQILRQIWGVAHVEQPHVLRVNISNLRRKIESDPTRPRYLLTEPGVGYRLKAE

SEQ ID NO: 10813 - protein, 230 aa, Pseudomonas syringae pv B728a
MSQATTILVIDDEPQIRKFLRISLASQGYKVLEAATGAEGLTQAALNKPDLLVLDLGLPDMDGQQVLSEFREWSAVPVLVLSVRASEAQKVQALDAGANDYVTKPFGIQEFLARVRALLRQASGSDKPESALEFGPLTVDLAYRRVLLDGLEVALTRKEYAVLAQLARHPGRVITQQQLLKDIWGPTHTEDSHYLRIVVGHLRQKLADDPTAPRFILTEPGIGYRLLADH

SEQ ID NO: 10814 - protein, 231 aa, Ralstonia eutropha JMP134
MPFEFSPTVLLVEDEPHIRRFVRAALQAEGCTVREADSLKRGLIEAGTRQPDLVILDLGLPDGDGVDLIREVRTWTEVPVLVLSARSAEEDKIGALDAGADDYLTKPFGVGELVARLRVLLRRHARSNPHGSAQIAFGEVQVDLANRMVTRAGEPVHLTPIEYRLLSVLIAHRGKVMTHRELLREVWGPSHSESSQYLRVYMGHLRHKLEADPAQPAHLLTEVGVGYRFAG

SEQ ID NO: 10815 - protein, 230 aa, Rhodopseudomonas palustris HaA2
MSVKSRVLVVDDEPAILRFLKPALEANGYDVSHAATVTEAIKRVAADAPDIVLLDLGLADGDGKDVIRQVRAWSDLPILVLSAREREAEKIESLDLGADDYVNKPFNSGELMARMRAALRHRMQRNAEPAALSVGGIEIDAVRHRVTRDGDEIKLTPKEFELLAFLVRHAGRVVTHRQILAAVWGPAHTSDTQYLRVYIGQLRQKIEAHADEPRIILTEPGIGYRIGDAG

SEQ ID NO: 10816 - protein, 230 aa, Nitrobacter hamburgensis X14
MSTTKSRVLVVDDEAAILRFLKPALEANGYDMSSTATVADAVKRIAADAPDIVLLDLGLADGDGKDVLRRVREWSDVPVIVLSARDREAEKIDSLDLGADDYVNKPFNVGELMARMRTALRHRLQRNAETPSLRAGDLEVDVVRHRAMRAGVELKLTPKEFELLSFLAKNAGRVLTHRQILAAVWGVAHTADTQYLRVYIGQLRQKIEDKADDPRIILTEPGIGYRISES

SEQ ID NO: 10817 - protein, 231 aa, Cupriavidus metallidurans CH34 uid250
MPFDYSPTVLLVEDEPHIRRFVRESLQSEGCTVHEADTLKRGLIDAGTRQPDVVILDLGLPDGDGMTLIREMRTWTEVPVLVLSARTGEADKIAALDAGADDYLTKPFGVGELVARVRVLLRRHAKANPQGTPQITFGDVRVDLANRLVTRGEDQVHLTPIEYRLLAVLIANRGKVMTHRELLREVWGPSHSESSHYLRVYMGHLRHKLEVDPAQPAHLLTEVGVGYRFAG

SEQ ID NO: 10818 - protein, 230 aa, Pseudomonas aeruginosa UCBPP-PA14
MTQLQNSILLIDDEPQIRKFLRISLNAQGYRVLEAGTGEEGLAQAALNRPDLVVLDLGLPDRDGQDILRDLREWSQVPVLVLSVRASEGEKVLALDGGANDYVTKPFGIQEFLARVRVLLRQAAQGESPEAAVAVGPLQVDFAYRRVTLEGAEVALTRKEYAVLAALARHLGRVVTQQQLLKDIWGPTHVEDTHYLRVVVGHLRQKLGDDPASPRFLVTEAGVGYRLRDS

SEQ ID NO: 10819 - protein, 235 aa, Polaromonas naphthalenivorans CJ2
MVTPVVVIIEDEPQIRRFVRSALEAEGWQVFEAGTARQGLTEAGTRKPDLLVLDLGLPDGDGLDVIRDVRGWSGVPIIVLSARSGEADKIAALDAGADDYLTKPFGVGELLARVRANLRRPRAAATDGTPAEEADPVFRFGAVEVDRRARLVRRAGAEVHLTPIEYRLLSVLIANAGRVLTHRQLLREVWGPSHAGQSHYLRIYMGHLRQKLEPDPAQPQHLLTETAVGYRLVVT

SEQ ID NO: 10820 - protein, 229 aa, Serratia proteamaculans 568
MSNTPTNILIVEDEKEIRRFVRTALESEGLRVFESETLQRGLIEAGTRKPDLIILDLGLPDGDGLNYIRDLRQWSAIPVIVLSARNAEEDKIAALDAGADDYLSKPFGIGELLARVRVALRRHSGSLQESPLVSFSEITVDLINRRVLRQGEDLHLTPIEFRLLAELLANSGKVLTQRQLLSHVWGPNYVEHSHYLRIYMGHLRQKLEADPARPKHLLTETGVGYRFMP

SEQ ID NO: 10821 - protein, 231 aa, Pseudomonas putida GB 1
MSQSATLLVIDDEPQIRKFLRISLASQGYKVLEAATGEEGLAQAALGKPDLVVLDLGLPDMDGQQVLRELREWSAVPVMVLSVRASEVQKVDALDGGANDYVTKPFGIQEFLARVRALLRQVPQAGGSEVAASFGPLTVDFAFRRVTIDGVEVALTRKEYALLALLAGHPGRVITQQQLLKDIWGPTHVEDTHYLRIVVGHLRQKLGDDPTAPRFIITEAGVGYRLVAPTA

SEQ ID NO: 10822 - protein, 232 aa, Azotobacter vinelandii DJ
MSGVQQSILVIDDEAQIRKFLRISLVAHGYRVLEAGCGREGLTLAAEARPDLLVLDLGLPDMDGKELLAELRRDSQVPVLVLSVRAGDGEKVLALDGGANDYVTKPFSIRELLARVRVLLRRPASPGQGPGTLNCGPLAVDLDNRRVDLDGREIALTRKEYDVLAMLARHPGRIVTQQQLLRDIWGPTHVEDSHYLRVVVGHLRQKLGDDPADPRFIVTEAGIGYRLREQAP

SEQ ID NO: 10823 - protein, 230 aa, Variovorax paradoxus S110
MPSPTAIVIEDEPQIRRFVRGALEAEGWLVHEAGTLREGLAAAGTRQPDLLVLDLGLPDGDGVSLIRDVRGWSAVPIIVLSARSDEADKIAALDAGADDYLTKPFGTGELLARVRANLRRPRAAGGDEAAEAVFRFGEVELDRAARIVRRAGAEVHLTPTEYRLLSVLVANAGRVLTQRQLLREVWGPSHTDQSHYLRIYMGHLRQKLEADPAQPRHLLTETAVGYRLVV

SEQ ID NO: 10824 - protein, 114 aa, Jannaschia CCS1
MKAYANRAHPLWLAYILHRLSGLFLALFLPLHFWILAMAMTDPTRFDGFIAFTEIGVVKLAEFGLVFLLAVHMFGGLRLMAMEWLPWSGPQKTLAAGATAASFFIATLFFMQAI

SEQ ID NO: 10825 - protein, 114 aa, Rhodobacter sphaeroides 2 4 1
MISLAHRSHPLWLAYLVHRLSGLGLALFLPVHFYMLAMVLTDPEGFDSFGLWTQNPLVKMAEFGLVFLLAAHFFGGLRLLALEMLPWSGRQKTLAAATVAGAFLVAATFLLRAI

SEQ ID NO: 10826 - protein, 116 aa, Verminephrobacter eiseniae EF01-2
MRSPRNHRAYWAFLGHRISGLALGLFLPAHLYVLGLALEESRRLEQFLKFAELGAVKFGEWGLVILLSVHMCFGLRLLALELLPWSSSRDARLSWITWGAVLSAVVGVVLAVRVMR

SEQ ID NO: 10827 - protein, 114 aa, Rhodobacter sphaeroides ATCC 17029; identical to SEQ ID NO: 10825

SEQ ID NO: 10828 - protein, 125 aa, Methylobacterium radiotolerans JCM 2831
MMTAASTAGRTGITRASLRRPGFAAALIHRLSGIALALFLPMHFIALGTALQGADRLERFLGLTHNGFVRTAEWGLVCALAVHMALGLRVLAIEWLRFRERNARVVSGCLATAFAIGLLFLLSGA

SEQ ID NO: 10829 - protein, 115 aa, Methylobacterium nodulans ORS 2060
MSAPRSYCRNALWIAAMVHRISGLGLAAFLPFHFLALGLSLQGASELDGFLHWTDTPVVKIAEGGLVFLLAVHFLGGLRVLFVENFDWRVNQLRLASAAGATAAVIAFAFLVRVL

SEQ ID NO: 10830 - protein, 114 aa, Variovorax paradoxus S110
MKTARSHQAYWAFLGHRLSGLALALFLPVHFYVLGMALDEARLDRFLKLSEMPAMKFGEWGLVLLLTLHMFLGLRLLALELLPWSSTRDARLAWIGWGFAASMAFGFAFIAGVI

SEQ ID NO: 10831 - protein, 100 aa, Methylococcus capsulatus Bath
MLYAILCEDRPGSLEMRKGARPAHLQRLDRLQDEGRLVLAGPHPAIDCEDPGEAGFTGSLIVAEFPSLEDAQRWADEDPYGRAGVYARVVVKPFRQVYPK

SEQ ID NO: 10832 - protein, 100 aa, Dechloromonas aromatica RCB
MLYAIIAEDKAGTLDKRLAARPAHLERLLALQSEARLILAGPCPAIDSPDPGPAGFSGSIIIAEFGSLTAAQTWADADPYIAAGVYEKVTIKPFKKALPA

SEQ ID NO: 10833 - protein, 100 aa, Thiobacillus denitrificans ATCC 25259
MFYAIVGQDAEGSLTKRAAARPAHLERLQRLQDEGRLLLAGPFPAIDALDPGAAGFSGSLIVAEFGTLDDAQAWASADPYVAAGVYSEVSVKPFKKVLPA

SEQ ID NO: 10834 - protein, 99 aa, Nitrosococcus oceani ATCC 19707
MLYAIIGQDIDHSLERRRQVRSEHLARIRKLQENGHLVLAGPFPALDTQDPGEAGFTGSLIVAEFSSLEAAQQWAEADPYVEAGVYAQVTVKPFKQVLP

SEQ ID NO: 10835 - protein, 101 aa, Nitrosospira multiformis ATCC 25196
MMLYAISGEDVPDSLDKRMAVRPAHLERIKALQEDGRLVLAGPYPAIDSPDPGPAGFSGSLIVAEFESLEAAQAWAEADPYATSGVYAKVTVKPFKKVLPA

SEQ ID NO: 10836 - protein, 100 aa, Methylobacillus flagellatus KT
MWYTIIAEDVPGSLEKRLAARPPHLERLKALQDAGRLLLAGPFPAIDSNDPGPAGFTGSLIVAEFDSLESAQAWANEDPFVNAGVYSAVTVKPFRKTLPA

SEQ ID NO: 10837 - protein, 99 aa, Alkalilimnicola ehrlichei MLHE-1
MYYAIISEDVPNSLPLRKEARPAHLARLEALRDEGRLLIAGPHPAIDAEDPGEAGFSGSLVVAEFPSLEAAKAWANADPYLDVGAYERVTVKPFKKVLP

SEQ ID NO: 10838 - protein, 86 aa, Xanthomonas oryzae PXO99A
MAARQQARPAHLARLQALAAAGRLLVAGPCPAIDAEDPGPSGFSGSVVIAEFDALEDARAWANADPYVEAGVYARTEVRPFRRVLP

SEQ ID NO: 10839 - protein, 99 aa, Stenotrophomonas maltophilia R551 3
MWYVIEGYDGQDVLAQRLQARPEHLARLHALRDEGRLLLAGPCPAVDSEDPGPAGFSGSVVIAQFDSLPQAQAWADADPYVAAGVYTHVQVRPFRKVLP

SEQ ID NO: 10840 - protein, 100 aa, Acidithiobacillus ferrooxidans ATCC 53993
MYYCIIGTDNADSLGKRQAARGDHLARLHQLQSEGRLLTAGPFPAIDSEEPGEAGFTGSLIIARFDSLEDAHTWAAAEPYLSAGVYADVSVRPYKGVFLP

SEQ ID NO: 10841 - protein, 99 aa, Thauera sp. MZ1T
MLYALIGEDAPGALETRLAVRPQHVARLEALRDDGRLLLAGPMPAIDSPDPGPAGFAGSLIVAEFDSLASAEAWLRDDPYVRQGVFVRTTVRPFRKTLP

SEQ ID NO: 10842 - protein, 109 aa, Acidithiobacillus ferrooxidans ATCC 23270
MHLTNRKRFMYYCIIGTDNADSLGKRQAARGDHLARLHQLQSEGRLLTAGPFPAIDSEEPGEAGFTGSLIIARFDSLEDAHTWAAAEPYLSAGVYADVSVRPYKGVFLP

SEQ ID NO: 10843 - protein, 69 aa, Pseudomonas syringae tomato DC3000
MEDTDLQALMKRVELLLKYAEQLKGQNALLLAQEKTWREERAQLIEKNEIARQKVESMISRLKALEQDS

SEQ ID NO: 10844 - protein, 69 aa, Pseudomonas syringae pv B728a; identical to SEQ ID NO: 10843

SEQ ID NO: 10845 - protein, 69 aa, Nitrosococcus oceani ATCC 19707
MVENMVKQLERRIEELIDLCNHLREENQLLREQNADLISERAKLIEQTELARSRVEGMITRLKSMEQAS

SEQ ID NO: 10846 - protein, 69 aa, Saccharophagus degradans 2-40
MSNIAMEQVEAKLDELIGLCTRLEKENATLRAKEDSWQQERLRLLEKNEIARKRVEAMIERLKKIHTEA

SEQ ID NO: 10847 - protein, 71 aa, Alkalilimnicola ehrlichei MLHE-1
MADSVTEELVRLEQRVEALLKADARLREENRVLRQSLEQLNAERASLKEKNDLARSQIEAMISRLRAMEHG

SEQ ID NO: 10848 - protein, 103 aa, Pseudomonas aeruginosa UCBPP-PA14
MRPVAGAPARPGHWPRPGTILYSCPITPIPKREPMEDADLQLLTAKFDQLLQKLEQLKAENRLLRANEKSWREERAHLIEKNEMARHKVEAMILRLKALEQDT

SEQ ID NO: 10849 - protein, 70 aa, Halorhodospira halophila SL1
MSDYSVEELVRLEQRIEQLLRQHERLREENRLLREAQEQLQADRAALQEKNELARSQIESMISRLKAMEQ

SEQ ID NO: 10850 - protein, 68 aa, Marinobacter aquaeolei VT8
MEQSEVQALADKLDKLIERCDKLEKDNALLRELQDDWNRERAQLMHKNDLAKNKIEAMIGRLRALEHH

SEQ ID NO: 10851 - protein, 69 aa, Pseudomonas mendocina ymp
MEDADLHVLTAKLELLIQRVEQLKAHNRLLLANEQAWREERAHLIEKNELARHKVESMISRLKALEQDT

SEQ ID NO: 10852 - protein, 72 aa, Pseudomonas putida F1
MQPTQENDLQALMSRFELLIERVEQLKRQNALLVAQEKSWREERAHLIEKNEIAKRKVESMILRLKALEQDS

SEQ ID NO: 10853 - protein, 69 aa, Pseudomonas aeruginosa PA7
MEDADLQLLTAKFDQLLQKLEQLKAENRLLRANEKSWREERAHLIEKNEMARHKVEAMILRLKALEQDT

SEQ ID NO: 10854 - protein, 70 aa, Coxiella burnetii RSA 331
MQPTHTLELSELEYQVDHLLRSLERLKSENNALRQKLATQVRERSLLVEKNLQAAQKIKKVITQLREEMP

SEQ ID NO: 10855 - protein, 72 aa, Pseudomonas putida GB 1
MQPTQENDLQALMSRFELLIERVEQLKRQNALLLAQEKSWREERAHLIEKNEIAKRKVESMILRLKALEQDS

SEQ ID NO: 10856 - protein, 72 aa, Pseudomonas putida W619
MQPTQENDLQALMSRFESLIERVEQLKRQNALLVAQEKSWREERAHLIEKNEIAKRKVESMILRLKALEQDS

SEQ ID NO: 10857 - protein, 73 aa, Xylella fastidiosa M12
MDQPDALTELHSLAAQLERLIEYCQRLAEENHNLRCQQHQMMLERRELLAKNEQARSRVEAMITRLKTLEQHT

SEQ ID NO: 10858 - protein, 73 aa, Xylella fastidiosa M23
MDQPDALTELHSLAAQLERLIEYCQRLAEENHNLRCQHHQMMLERRELLAKNEQARSRVEAMITRLKTLEQHT

SEQ ID NO: 10859 - protein, 89 aa, Xanthomonas oryzae PXO99A
MRARLTTPRARAYRERMDNAAALAQIRALAARVEALVERTQRLTDENRSLRHQQEQLIGERSQLLTKNEQARSRVEAMIAHLKSLEQHT

SEQ ID NO: 10860 - protein, 73 aa, Stenotrophomonas maltophilia R551 3
MEPADPLAQLQDFAARVEALLERNQRLAEENRSLRHQQEQLVAERSTLLAKNEQARSRVEAMISRLKSLEQHT

SEQ ID NO: 10861 - protein, 77 aa, Thioalkalivibrio HL EbGR7
MDTINTQDIAEQELRKLEVRVGELIRTCERLKEENRLLREQQVNLAAERSSLVEGQEAARLKVEAMIARLKSMEQSA

SEQ ID NO: 10862 - protein, 69 aa, Azotobacter vinelandii DJ
MEDDDLKALARQLELLIQRLEQIKAHNRFLLANEKAWREERAHLIEKNEIARHKVESMISRLKALEQDS

SEQ ID NO: 10863 - protein, 96 aa, Shewanella oneidensis
MSFKELLIEDQRLVILRSLREMPAYEANESIVDCCLESYGHNISRDQVRTHLAWLEEQGLITIRKLDDYKIARLTGRGEDVATGQATVPGVKRPRA

SEQ ID NO: 10864 - protein, 98 aa, Methylococcus capsulatus Bath
MNLENFETEQRRLVILRRLIRAPAYTLDQTVLAKALALEGLAVSRDRLKTDLAWLAEQDLIVGQQPGGVWVATLTHRGLDVAKGLTVMPGVARPEPGE

SEQ ID NO: 10865 - protein, 102 aa, Methylobacillus flagellatus KT
MSFKKILQEDRRYLILRALNESKSYRASLILLQAFLESFGQAVSGDVVKGEVAWLEDQGLVRSEKTGQIITVQLLGPGADIAAGRATYPGVRQPTPDELDNG

SEQ ID NO: 10866 - protein, 101 aa, Rhodobacter sphaeroides ATCC 17025
MSDYAETLRRHRRLAILRFLEESPTYTSNASVLTDVLNSNAIGIDTSRDQTATELAWLAEQGFVTLAGSREFWVPTATARGVDIALGRATHPEIQRPGPRR

SEQ ID NO: 10867 - protein, 96 aa, Vibrio cholerae O395
MSFKELLTEDQRLVILRSLHEMHGYEANESIIDSCLDAYGHKISRDVVRTHLFWLQEQGLVSLRDVGDCQIARLTGRGEDVATGQAVVPGVKRPRA

SEQ ID NO: 10868 - protein, 98 aa, Shewanella baltica OS185
MAMQQIINEHQRLVVLRLLTEAGAFALNESILQDGLNAYGLDISRDALLVQLAWLNEQGLIKTELVGKVTTATLTGRGQDVATGRTVVPGVKRPRAGE

SEQ ID NO: 10869 - protein, 101 aa, Xanthobacter autotrophicus Py2
MSIADTMGKDRRRLILEHLAAAEGYGLGLGVLVSLVGQARHGAWRDVVEGDVTILAQHNLVATEDLPSALGPQRWVTLTGLGLDVARGRAHPAVADKLPSY

SEQ ID NO: 10870 - protein, 98 aa, Shewanella baltica OS195
MAMQQIINEHQRLVVLRLLIEAGAFALNESILQDGLNAYGLDISRDALLVQLAWLNEQGLIKTELVGKVTTATLTGRGQDVATGRAIVPGVKRPRAGE

SEQ ID NO: 10871 - protein, 101 aa, Leptothrix cholodnii SP 6
MSATPKFAEFQQMDRRLSILQCLAAAAQYRVNVGLIQRYCDAVGHAVSRDRLYADLTWLSEQALVEVNDSGVWVTTLTERGLDVSSGRAKCPGVAQPQPGT

SEQ ID NO: 10872 - protein, 103 aa, Rhodopseudomonas palustris TIE 1
MSDTLAEVFDKDRRLVLLRLLAEQDNYELSAPLLTKAAQELRHRVYPDVVEADIVLLDQHRLVTRSEIELSGRKMTIATLTKLGRDVAHGRPHPMVARPSPKD

SEQ ID NO: 10873 - protein, 98 aa, Rhodopseudomonas palustris TIE 1
MSRDIIREEARLIMLRELHGQTNYALNDALLRDVLESFGIAKTREWVREEIGYLENVGAVTRTSAGSVVVAKLTPKGVEHVERRLVIEGVKRPSPAEA

SEQ ID NO: 10874 - protein, 105 aa, Thioalkalivibrio HL EbGR7
MSYQGNSYQDYETEGRRLGILRILARRNAYTANEYSLNDELRGAYAHHVSRDRLHGDLAWLEEQGLVIVQQPRAGWVVTLTARGGDVAEGHAQVPGVARPRPGIV

SEQ ID NO: 10875 - protein, 105 aa, Agrobacterium vitis S4
MNSIAVDYEKLTREKARLVILQELAKQTNESLSSPFFDGALRLSAIYQDLPWVNQQIEYLRNLSAVKVLDVDEDVKIATLTDHGKRHLDREITIQGVQRPRRPGI

SEQ ID NO: 10876 - protein, 100 aa, Brucella suis 1330
MIVKVLTANRLIDGQAVWLGADGSWQETIDGALVARHAEAVNALEEAGRLAARANLVVDVNVIDVEERGADLYPIRLRERIRLSGPTIVTMGHAFPAPAS

SEQ ID NO: 10877 - protein, 104 aa, Rhodopseudomonas palustris HaA2
MTSPLQQKIKITGPSVVTANRTVDGVVIYRTADRGWSIDLADAAIVREAEPARALLAESVADDVGAVGAYIAPVKVDDTGAILPGNLREQIRNSGVTIELPAHA

SEQ ID NO: 10878 - protein, 98 aa, Novosphingobium aromaticivorans DSM 12444
MKIITGNDLRTGDVIWWTGEGWSRHVNDAVEAGEHAEAIIARENAKQIVTDTHVIDAEQTADGVRPAHIKDRIRALGPTVRLDLSLKPADPAAGNWVI

SEQ ID NO: 10879 - protein, 110 aa, Rhodospirillum rubrum ATCC 11170
MTSSDPVKAGSVFSAEVITANRLTDGKVVYRRGDGGWSADLAEALTLSGEALAAELDRARAEPDTAVVGIYSHALEGGEPAHLRERIRAQGPTVQAGAGLPLSKIQSKAS

SEQ ID NO: 10880 - protein, 102 aa, Mesorhizobium BNC1
MKLLAANRLLDGTAVWLGPDAAWVEDISDAEIARDKEGEARLEQIGRRALAENLVLDIELIDVEIVDGAVRPLRLRERIRAAGPSIHPELGKQANKPAVSLV

SEQ ID NO: 10881 - protein, 100 aa, Brucella ovis; identical to SEQ ID NO: 10876

SEQ ID NO: 10882 - protein, 105 aa, Sinorhizobium medicae WSM419
MVEKVLTANRLADGISVWLDASGNWVESLQDAFVARHAEAVAALEATGKRSFDENKVVDVNVIDVEEVDGTLRPLRMRERIRAEGPSIPYAPGYNGLAGPKNVAA

SEQ ID NO: 10883 - protein, 105 aa, Ochrobactrum anthropi ATCC 49188
MVVKVLTANRLIDGQAVWLGADGSWQETIDGALVARHVEAVEALEDAGKVAAKANLVVDVNVIDVEEREEGLYPIRLRERIRLSGPTIVTFGDLPLEKPELKRAS

SEQ ID NO: 10884 - protein, 121 aa, Caulobacter K31
MKAVTANRLTDGEVVFWNAGAWVESFGDAQLFEDSQETEVEAAVAKGKSQATVIVDPYPIDLAPVEGGLAPVSYRERIRALGPTNEPTHGKQAVGGEMIEALRHAAGAARSTGRVDLIRRK

SEQ ID NO: 10885 - protein, 104 aa, Rhodopseudomonas palustris TIE 1
MTSPLQQKIKITGPSVVTANRTTDGVVIYRTAKSAWSTDLADAAIVREAEPARALLAAATADDVGAVGAYIAPVEIGADGGIYPGNLREKIRRNGVTIALPGQA

SEQ ID NO: 10886 - protein, 104 aa, Rhizobium leguminosarum bv  trifolii WSM2304
MVDKVLTANRLTDGIAVWLDANGKWSTSLQEALVARHNEAVEALEAIGKKSYADNEVVDVAVVEVQETNGVLWPLRLRERIRAQGPTMEYAPGYAPADPEFIAV

SEQ ID NO: 10887 - protein, 104 aa, Agrobacterium vitis S4
MAEKVLTANRLSDGIAVWLDASGKWVEDLQSSLVARHAEAVAALEASGKRDFTNNLVVDVAVVDVEERDGKLWPLRLRERIRAAGPTIPYADGHGHADPDFVAV

SEQ ID NO: 10888 - protein, 104 aa, Rhizobium leguminosarum bv  trifolii WSM1325
MGDKVLTANRLTDGIAVWLDANGKWSTSLQEALVARHAEAVEALEAIGKKSYADNEVVDVAVVDVQETNGILWPLRLRERIRAQGPTMEYAPGYAPADPEFIAV

SEQ ID NO: 10889 - protein, 66 aa, Jannaschia CCS1
MSDGDTNGPTGPIDRRMLEALVCPMTQAPLSYDAEKQELISKAAHLAYPIRGGIPIMLEEEARKLD

SEQ ID NO: 10890 - protein, 66 aa, Rhodopseudomonas palustris BisB18
MTTSASDRPEAGVDRKLLDILVCPITKGPLEFDAARQELISRGAKLAYPIRDGIPIMLPEEARKLG

SEQ ID NO: 10891 - protein, 65 aa, Rhodopseudomonas palustris BisB5
MTTSSERPETSVDRKLLEILVCPVTKGPLEFDAARQELISRGAKLAYPIRDGIPIMLPEEARKLG

SEQ ID NO: 10892 - protein, 61 aa, Ruegeria sp. TM1040
MNETTPAFDRHMLEALVCPVTQTVLEYDAEAQELVSRAANLAFPIRNGIPVMLTDEARPLE

SEQ ID NO: 10893 - protein, 59 aa, Rhodobacter sphaeroides 2 4 1
MTGTTLFDRRMLEALVCPVTQAGLAYDADRQELISKQARLAFPIRDGIPIMLVSEAREL

SEQ ID NO: 10894 - protein, 59 aa, Rhodobacter sphaeroides ATCC 17029
MIGNTLFDRRMLEALVCPVTQAGLAYDADRQELISKQARLAFPIRDGIPIMLVSEAREL

SEQ ID NO: 10895 - protein, 59 aa, Rhodobacter sphaeroides ATCC 17025
MTESPQFDRRMLEALVCPVSQSGLSYDAERQELVSRQARLAFPIRDGIPIMLVSEAREL

SEQ ID NO: 10896 - protein, 61 aa, Sphingomonas wittichii RW1
MNDRTTSLDPELLAILVCPVTRTPLRYDEAAGELVSDAAGLAFPIRNGVPVMLIEEARALS

SEQ ID NO: 10897 - protein, 62 aa, Sinorhizobium medicae WSM419
MDVNASKVDPKLLELLVCPLTKGRLSYDPEANELVSEKARLAYPIRDGVPIMLISEARKIEE

SEQ ID NO: 10898 - protein, 140 aa, Xanthobacter autotrophicus Py2
MPASAGLMDRTRLGVKRPPAPAMVAPPRSGAIRRSLAFLHDAGPRRLVSNAFSAREPVCAAPENALTSVAMIQAQRPGHDVDPKLLEILVCPLTKAPLEYDRERQELVSRAARLAYPIRDGIPIMLADEARKLDESELSR

SEQ ID NO: 10899 - protein, 66 aa, Caulobacter K31
MTTAPPPPPADLDPRLLEVLVCPVTRAPLFYDRARGELISNAAKLAYPIRDGVPIMLPEEARTLED

SEQ ID NO: 10900 - protein, 65 aa, Rhodopseudomonas palustris TIE 1
MSLSPSERPDTVDRKLLDILVCPVTKGPLEFDPARQELISRGAKLAYPIRDGIPIMLPEEARKLG

SEQ ID NO: 10901 - protein, 62 aa, Rhizobium leguminosarum bv  trifolii WSM2304
MDEKLSRVDPKLLDLLVCPLSKGRLSYDREHNELVSEKARLAYPIRDGIPIMLVSEARRLDE

SEQ ID NO: 10902 - protein, 62 aa, Agrobacterium vitis S4
MDQRMNGVDPKMLELLVCPLTNGRLTLNRENNELVSEKARLAYPIRDGIPIMLVSEARKIED

SEQ ID NO: 10903 - protein, 62 aa, Rhizobium leguminosarum bv  trifolii WSM1325
MDEKLSRVDPKLLDLLVCPLSKGRLSYDREQNELVSEKARLAYPIRDGIPIMLVSEARRLDE

SEQ ID NO: 10904 - protein, 146 aa, Pelobacter carbinolicus
MFEEKKLQELKDMCRSRGVSLTPQRLAVMRVLTARRDHPTVDQLYDDLTEQMPGMSRTTVYRVLETFERLGLVRKIDSRASKAHFDADTSLHPHMVCLGCGKVVDYQDRGFGILEPPGITDDGFEIIDYAVTLVGYCRQCRRNVDN

SEQ ID NO: 10905 - protein, 149 aa, Chlorobium luteolum DSM 273
MMNATTEGSMTEEFMLRCRAHGLKITPQRLAIFKALAGSKEHPSADGVYRKLVALHPTISFDTVNRTLLTFAEIGIIETVESHSGVRRFDTDLMSHHHLHCVQCGRIIDFTDETLDKVPVPEKAIGNFTVLGKRMVVSGICESCRKKHA

SEQ ID NO: 10906 - protein, 146 aa, Frankia CcI3
MNDQTDLRLTPQRMAVLAVLAAARDHPTAAEVHERVRTVSPGIGSATVYRTLALLVSAGRALELNLGDGTAARYDANTSRHDHVVCDGCRRAVDIDHPVLDGMMAQIACRSGFAITGYDLRFRGLCPDCQANGSGPARGAAGTGQQ

SEQ ID NO: 10907 - protein, 149 aa, Pelobacter propionicus DSM 2379
MTPLSNSIDHLTQTFRESGLRVTHQRLEIYRELMEARDHPTAEQLYRRLRGRIPTLSLDTVYRTLTTLVTHGMVKRLETVESQARFDTTRQRHHHIICKRCNEIMDFHWPLLDETPLPGEVDSWGRLDGVNVVVYGVCARCLAGDAQPT

SEQ ID NO: 10908 - protein, 128 aa, Desulfovibrio vulgaris DP4
MSQTRMTKQRMVILEELRKVDTHPTADEIYAMVRSRIPRISLGTVYRNLDLLAESGEILRLEAAGTQKRFDGNTMHHQHVRCIRCGRVGDVMHPLDVPQPERAAAKGFTILTARVEFEGICDHCTAHS

SEQ ID NO: 10909 - protein, 137 aa, Fervidobacterium nodosum Rt17-B1
MNVTELLKEKGVKPTVHRVEILDYLMSTYSHPTADEIYYHFKKGQKLAVISRATVYNTLKALADAGLISIIITPDAIRYDFVRKKHHHFYCTNCKTIYDVELEVELPEIKSIDNHEVHHVQLTLVGICEKCKTNQEI

SEQ ID NO: 10910 - protein, 141 aa, Frankia EAN1pec
MPERTELRLTPQRTRVLEVLKAAEDHPTAAEVYERVRLAAPGIGSATVYRALALLVETGHALELNLGDGAAARYDANTSRHDHAVCERCGRAADIDHPVPDGMVAEIARRSGFTITGYDLQFRGLCPECQTAGEGHRPGRR

SEQ ID NO: 10911 - protein, 134 aa, Caldivirga maquilingensis IC-167
MSEDLANLLRSRGLKVTPQRIAILKLLSSGGHYTIEHVHDKLRDIEPGISISTVYNTLSTLTRLGVLRSFEANGKTWYEIAKHPHLNVICENTGQIIDIDVDLTWIMDELMRRGIKVKDLNIIVNGDCSKMEGK

SEQ ID NO: 10912 - protein, 133 aa, Elusimicrobium minutum Pei191
MRYSKQREIILNALKSNPIHPTADYVYNSLKKDNPSLSLGTVYRNLNLLSDIGVIRKIRGMGNSEHFDYNTHNHAHFICAKCSRIFDIDIDGNFYEILNLIAKKNGLDIEPGGLVLKGMCKNCKKDKNKERKQ

SEQ ID NO: 10913 - protein, 131 aa, Desulfovibrio vulgaris  Miyazaki F
MTQPQQTRMTKQRMVILEELRNVHSHPTADEVYGMVRQRLPRISLGTVYRNLDLLAESGDILKLESAGSQKRFDGNVTPHQHVRCTQCGRVGDVMEPVRLPDISGAGAPGFIILSGRIEFEGVCEACASKN

SEQ ID NO: 10914 - protein, 143 aa, Thiobacillus denitrificans ATCC 25259
MTEIIFYTFAEDRLDVARRVAAKAYGQGKQVMIYAPDAAVAGAVDRMLWTTPALGFVPHARDSDALAAETPVLIGADAGALRHADVMINLDSAQPPAFGRFERLVEIVGTDDAEREQGRARYRFYQSRGYALKTHDLRQQSEG

SEQ ID NO: 10915 - protein, 144 aa, Rhodoferax ferrireducens T118
MTEVAFHFNAPDRVAYACRLLRKAAASGAKLVVIGSPDVLQQLDRALWTFSAVDFVPHCFLESESHVVAASPVILSTSTHAVPHQQVLLNLGQLVPEGFERFERVIEVVGQEDEDRQSARSRWKSYADRGYVITRHDLALKTSY

SEQ ID NO: 10916 - protein, 145 aa, Polaromonas JS666
MTEIAFHFNVPDKLAYGCRLLRKAYLSGASVVVTAEADVLAQLDQSLWSFSPTEFVPHCRSDAGEDNLAVTPVLLAESLQDCARHEVLVNLGQGIPAGFERFERFIEVVAQGDDERLAARSRWKHYTDRGYTMKRHDLATAKGGA

SEQ ID NO: 10917 - protein, 144 aa, Acidovorax avenae citrulli AAC00-1
MTEIAFHFNAPDKLAYACRFARKAVRSDALLVITGPSAVLDAVDRALWALGPQDFVAHCRQEDEADLREASPVLLATDPRAATHAQVLLNLGPTVPAGFERFGRLVEVVSSTDESDRAGARERWRHYAQRGYAIVRHDLVLKGG

SEQ ID NO: 10918 - protein, 146 aa, Acidovorax sp. JS42
MTQVAFHFNAPDKLAYVCRLVRKATRQDARVTVTGDADTLLRLDRQLWALAPSDFVGHCLGDADEEILRASPTVLVQDPRTSPNRDVLVNLGNVLPEGFAQYARVVEVVSQVDEDDRKRARERWRGYAALGYDIVRHDLVLKESAG

SEQ ID NO: 10919 - protein, 146 aa, Polaromonas naphthalenivorans CJ2
MTEIAFHFNVPDKLAYGCRLLRKAYLSGATVAVIAEPEVLAELDALLWSFSATEFVPHCTGAASPGTLAATPVVLAASPADCPGRDILVNLGQGVPGGFEGFERLIEVVSIHPEDVPAGRDRWKHYAARGYTLKRHDLASRARGAA

SEQ ID NO: 10920 - protein, 144 aa, Verminephrobacter eiseniae EF01-2
MTEVAFHFNAPDKLAYACRFARKVQRSDARLVIAAPAQMLAALDRMLWALEPQDFVAHCRDDADQELLAASAVLLAQDARSTAHHEVLLNLQPQVPQGFERFDRLVEVVSAQDPADRTEARARWRHYASLGLAITRHDLVPKAL

SEQ ID NO: 10921 - protein, 145 aa, Leptothrix cholodnii SP 6
MAMGAVAFHFNVPQRQDYTCRLLRKACRAGARVAVTGDSAALGELDRQLWIFDPIDFVPHWRGVSADRLPARLKATPIVLLDQAGTQAGHDVLLNLAEQVPDCASQFARVIEVVGRSEADRSQARLRWRHYASLGAAIERHEVRP

SEQ ID NO: 10922 - protein, 146 aa, Diaphorobacter TPSY uid29975
MTQVAFHFNAPDKLAYVCRLVRKATRQEARVTVTGDADTLLRLDRQLWALAPSDFVGHCLGDADEEILRASPTVLVQDPRTSPNRDVLVNLGNVLPEGFAQYARVVEVVSQADEDDRKRARERWRGYAALGYDIVRHDLVLKESAG

SEQ ID NO: 10923 - protein, 147 aa, Variovorax paradoxus S110
MTEIGFHFNLPDKANYACRLVRKAVSVRGLRVVVVGEPQMLEAVDAALWQLSPCDFIAHCRGDAQPHLVARSPVILCAEGADAAGLAHREMLVNLGPTVPVGFERFERLVDIVSNETDDRQIGRSRWRHYADRGYSIQPHDFARSAS

SEQ ID NO: 10924 - protein, 148 aa, Frankia CcI3
MSYTALAVVGVALAIAMDLWVLRTRLLTRRVFWTSYAIIALFQLISNGILTGFGIVVYDPRRILGPRIAHAPVEDLLFGFALVTQTLAWWVWWGRRLRGGPPGRPRSRRTGESREASDNGDNGDNGVNGENRGIPSRPEGRERSRRTS

SEQ ID NO: 10925 - protein, 113 aa, Mycobacterium MCS
MIGLGYTLPAIVAVVVVVAWEVLWLRTGLFRRPAYWISMVIVVGFQIPVDGWLTKLSDPIVIYNEEHTSGIRFPWDIPVEDFLFGFALVTGVLLLWERQRTRGVKVGERVHDE

SEQ ID NO: 10926 - protein, 113 aa, Mycobacterium KMS; identical to SEQ ID NO: 10925

SEQ ID NO: 10927 - protein, 113 aa, Mycobacterium JLS; identical to SEQ ID NO: 10925

SEQ ID NO: 10928 - protein, 100 aa, Frankia EAN1pec
MSYTALAVVGVAVSVLLDLRILRTRLLTRRLFWTAYAIIVFFQLVTNGILTGFDIVVYDPDAIAGPRLVFAPVEDLLFGFALVTQTLVWWVWWGLRHGNE

SEQ ID NO: 10929 - protein, 102 aa, Acidimicrobium ferrooxidans DSM 10331
MSYTLEAVALAIVAVAIDWWVTRSRVVRTASFWITWVVVAAFQIPVDGALTRLRAPVVEYRSGTYLGIRLGHAIPIEDFVYGFALVLVTISLWVRFGRRASR

SEQ ID NO: 10930 - protein, 108 aa, Actinosynnema mirum DSM 43827
MREYLIASAASVPLTVLLELLVLRTGLFRKRAYWITMAVVLGFQVPVDGWLTKLDAPIVVYADWAASGLRFPWDIPVEDFLFGFSMVTVTLLLWERARARKTEHADAR

SEQ ID NO: 10931 - protein, 130 aa, Saccharomonospora viridis DSM 43017
MTGLGYTLPAVLSVLAVCAWELLVLRTGLFRKPAYWISMAIMLGFQIPVDGWLTKLSAPIVRYVDEHTLGVRFPWDIPVEDFLFGFSLITAVLLLWEHQQRHGTRKRRERAWAPGAHETRPGVPQETEAP

SEQ ID NO: 10932 - protein, 108 aa, Nakamurella multipartita DSM 44233
MIGAYTAGAIGAIVAAVLMDLVIVRTRLLRTRLFWASYAIVVFFQLIVNGILTGLGIVQYDPEVILGVRLAYAPIEDLGFGFGLVTLTLVMWTRSGRTAAQRATEETR

SEQ ID NO: 10933 - protein, 218 aa, Anaeromyxobacter dehalogenans 2CP-C
MKRLLERSHALLTAPVGATPRVLALVAALLVVPTYVAPLWNLTMFAPQYGDGLRLDIYSYKLEGGNHGQDLKEINLLNHYIGMHDLAEEDFREFKWMPFVMGGLALVFLRAAVMGRVLDLLDSLVVFTWFGLFSLWSFGYKLYSYGHDLAPGAPVKVPPFMPPMIGSAQLANFEVYSYPGLGSYALFAVGLALAVALALGVRATLRRSAAAPLPRGGP

SEQ ID NO: 10934 - protein, 228 aa, Anaeromyxobacter sp. Fw109-5
MTRLLESSHRALSSPVGGTPRALVLAAALLLLPTYFLPLWNLTMFAPQYQGGLRLDIYSYKLEGGNEGQDLKEINLLNHYIGMRDLREDDFREFQWMPFVIGVLALLFLRAIVMGRLLDLVDSTVLFAWFAGFSGWSFAYKLYRYGHDLAPTAPVKVDPFMPPLFGGTQLANFEVYSYPAAGSYALLAAGLALVAALLLAARAALREARAARGGTSPAGASSARTAAR

SEQ ID NO: 10935 - protein, 251 aa, Campylobacter concisus 13826
MSKYKIYTIVALIIMSVCFTLPVLGWHGAKERIANGDELPSYAYTIYDLYSSFQYKNHLLPKEVASDLHKMIEQKAEIGTPSLPIWYVSLEAPNYPKAAFPDGIPVYFHVDGYSGDVHEMNTINHYIGMYPMEHGGNIERAIAPYYLLIATLCMLAFLYYDGKFNSLLMVPTIIAPVLFMSAFVGWLYWYGHNMQEWGAFKIKPFMPTVLGDGSVAHFTTHSYPTIGFWVMMVMSVLCILAVFSKKKELNA

SEQ ID NO: 10936 - protein, 206 aa, Opitutus terrae PB90 1
MRSLLRREYVFLRRPLSFGARIVLLLAVVSLVLALVLPLWRIGLVAPQYQEGLSLRIYSYQLVAGNNGQDLNEINNLNHYIGMKPLAEADFIEMRWVPFALGFFVLLGLRATALGTMRSLIDLLALYLYFTAFSFGSFYYRLYTYGHQLDPKAPMTIQPFTPVLIGRQQIANFLQSSWPEIGALFLGLFPVLIVLAMWMSRQEDPV

SEQ ID NO: 10937 - protein, 188 aa, Sulfurihydrogenibium YO3AOP1
MIKRVLLILAGILLIGVYFFPIWEILFYAPQYPEGLGMLIHVNKITGLGEHDIEIINDLNHYIGMKTIEENSIPELKIMPFILAFLIIYAFIAAIINKKLVTLTFSAIITLLGIAGLVDFYLWEYDYGHNLAPNAPIKVDPFQPAFIGHKPFLNFDIYSFPHIGGALLGLAIVLAWLSTYLYFKEGKK

SEQ ID NO: 10938 - protein, 218 aa, Anaeromyxobacter sp. K
MKRLLERSHALLTAPVGATPRVLALVAALLVVPTYVAPLWNLTMFAPQYGDGLRLDIYSYKLEGGNHGQDLKEINLLNHYIGMHDLAEEDFREFKWMPFVLGGLALVFLRAAVMGRLLDLLDSLVVFTYVGLFSLWSFGYKLYSYGHDLAPGAPVKVPPFMPPMMGSAQLANFEVYSYPGLGSYALFAVGFALAAALVLGVRGTRRRVVALPVPAGGP

SEQ ID NO: 10939 - protein, 199 aa, Desulfitobacterium hafniense DCB 2
MDFVRKLFKGNLNLIGRIMFGAAGLILLASLFLPWWHLDLVAPQYPEGLSVIVYPDKLDGRIDIINNINHYIGMKWISEEDFPEFQVITKVAYVIIGLALITALVKKRWLAWLTAGLGAVGGMIGVYDLWRWLRDYGTQLDPMAAIKIDPFTPPIIGTNKLANFITYTGFNSGGYLLGLSIILMLLAAWRFKEHEKQKE

SEQ ID NO: 10940 - protein, 218 aa, Anaeromyxobacter dehalogenans 2CP 1
MKRLLERSHALLTAPVGATPRVLALVAALLVVPTYVAPLWNLTMFAPQYGDGLRLDIYSYKLEGGNHGQDLKEINLLNHYIGMHDLAEEDFREFKWMPFVLGGLALVFLRAAVMGRLLDLLDSLVVFTYVGLFSLWSFGYKLYSYGHDLAPGAPVKVPPFMPPMMGGAQLANFEVYSYPGLGSYALFAVGFALAAALVLGVRGTRRRVVALPVPAGGP

SEQ ID NO: 10941 - protein, 284 aa, Halorubrum lacusprofundi ATCC 49239
MTASLDRLTELRRALPVTAAAMFVVALLVPVWRIAFEAPQYPEGLLVELYAYPRLGGDYAEVQALNHYVGFYYPDPVFVDPNYAVHPDAIAAPEWILGPVVFLAVAAAGVFVALAPTDRKLRLGLLGQLAGATVAFVGTFAIVQYRLFQAGHALGESAPVVGVREFTPPLLGGYEIANISGVAWFGPGGYLAGIGFLLLVVAYLLRDSQVTVGEAPGRVRDRLSGGNEDGDGDGEPEQIGPAAEEIAEAQTAANPESVSTPDGPTSDDSGTDGSTQNGPKTGVN

SEQ ID NO: 10942 - protein, 100 aa, Dechloromonas aromatica RCB
MCLGIPVQVIECGEHFARCAGRNGEVRVDLSLVGQQLPGTWLLTFLEAAREVIDAERAAAINAALNALAAAHAGETDFSDFFADLDREPQLPDFLRTQLS

SEQ ID NO: 10943 - protein, 100 aa, Cupriavidus metallidurans CH34 uid250
MCIGIPMQVVEADGRFALCEGRGERRRINTALVGEVSSGDWLLVFLDDARERIDTDRATEVNAALDLVLGAMQGLEAQDDAGFALPSQMSPEQMRALTGA

SEQ ID NO: 10944 - protein, 105 aa, Rhodobacter sphaeroides 2 4 1
MCVGDPLRLIAVEGIAGTAEDGAGTCLVDLSLVPEARPGDWVLSFLGTARAVIAADEAARISAALAALRSVMTGGPVGDAFADLDRPPSLPPHLQAALDAGRNHG

SEQ ID NO: 10945 - protein, 128 aa, Alkalilimnicola ehrlichei MLHE-1
MCIGIPMRVLECHGTWALAEGCQGVARVDLMLVGPQPVGSWLLVHIDTAREVIDGQRAAEIATALEALEAARAGVTVAGLFQDLEGREPQLPAHLRPQDDGDGSQPESAQRHSVGGKIYEPNPAGSTD

SEQ ID NO: 10946 - protein, 103 aa, Paracoccus denitrificans PD1222
MCMGIPMRLAQVDGIAGQSEGGDLIDLSLTADAQAGDWVLTFLGTAHEVIDADRAARIAAALQGLRAVMAGGDASGAFADLEGRTPALPSHLQAALAAGRKTG

SEQ ID NO: 10947 - protein, 108 aa, Polaromonas naphthalenivorans CJ2
MCIGIPMQVLSLEPGHANCQGRGQARRVRTALVGSVAAGDWLLVFLDSAQECIDAQRAQEINATLDLLEAVLQGHETKNTPDRLDHVAFELPSRMSREQLLALSTGIY

SEQ ID NO: 10948 - protein, 110 aa, Methylibium petroleiphilum PM1
MCIGLPMQVLSVEPGHAQCRGRGESRRVRTALVGDVAPGDWLLVFIDSAQERLTTERAREIDATLDLLEAVMHGDAADGVASFALPSRMNQDEVLALAGAASSPTLEKSP

SEQ ID NO: 10949 - protein, 105 aa, Rhodobacter sphaeroides ATCC 17029
MCVGDPLRLIAVEGIAGTVEDGAGTCLIDLSLVPEARPGDWILSFLGTARAVIAADEAARISAALAALRSVMIGGPVGDAFADLDRPPSLPPHLQAALDAGRNHG

SEQ ID NO: 10950 - protein, 102 aa, Rhodobacter sphaeroides ATCC 17025
MCVGEPHRLASVEGIAGRTEDGTLIDLSLTPEARAGDWVLCFLGAAREVITADAAARIADALAALRAVMAGGEVGAAFADLDRPPSLPPHLQAALDAGQSHG

SEQ ID NO: 10951 - protein, 110 aa, Xanthobacter autotrophicus Py2
MCLGLPMRIEEVEGSFALCRAEGARERVDLALVPEARTGDHVLVFQGTARRLLDADEARLITEALAGVAAIMAGEADAAVIDRAFADLADREPTLPPHLAAAYAAGRKEA

SEQ ID NO: 10952 - protein, 112 aa, Beijerinckia indica ATCC 9039
MCIGIPMRIVSLAGETALCVAEGREEQVDLALLSEAKVGEDVLVFLGLARRVLDPEEAAQIRAALGALAALSPASGEATVDLLQDGFADLMDREPQLPPHLEAARAAGLEEG

SEQ ID NO: 10953 - protein, 102 aa, Burkholderia phymatum STM815
MCVGIPARVRRANGLRAQCESRNGPCMVDLSLTGPLAPDTWVLTFLGAAREVIDEARARDIESALASLDAIAHGESGLDAYFADLADREPELPTHLRENITR

SEQ ID NO: 10954 - protein, 99 aa, Salmonella enterica serovar Newport SL254
MCIGVPVQVISPGQWFAKCRDRHGELIDVDIRLVAPPLAGAWLLTFGGAARREMDEAEAAEVLAALDSLEQAMLTQSDPLTGFADLLSRTPELPEHLKK

SEQ ID NO: 10955 - protein, 99 aa, Salmonella enterica serovar Heidelberg SL476; identical to SEQ ID NO: 10954

SEQ ID NO: 10956 - protein, 99 aa, Salmonella enterica serovar Schwarzengrund CVM19633
MCIGVPVQVISPGQWFAKCRDRHGELIDVDIRLVAPPLAGAWLLTFGGAARREMDEAEAVEVLAALDSLEQAMLTQSDPLTGFADLLSRTPELPEHLKK

SEQ ID NO: 10957 - protein, 99 aa, Salmonella enterica serovar Agona SL483
MCIGVPVQVISPGQWFAKCRDRHGELIDVDIRLVAPPLAGAWLLTFGGAARREMDETEAVEVLAALDSLEQAMLTQSDPLTGFADLLSRTPELPEHLKK

SEQ ID NO: 10958 - protein, 99 aa, Salmonella enterica serovar Dublin CT 02021853; identical to SEQ ID NO: 10954

SEQ ID NO: 10959 - protein, 106 aa, Azotobacter vinelandii DJ
MCIGIPLRVLECAPGRALCGDENGVRWIDTRLVEPPAPGDWLLVFLDAAREILDAGRAARIREALRALQAVQAGDPAALAGLFADLDREPQLPPHLQAQLPPKEPT

SEQ ID NO: 10960 - protein, 63 aa, Methylococcus capsulatus Bath
MSEGAEELKAKLKKLNAQATALKMDLHDLAEDLPTGWNRIMEVAEKTYEAYRQLDEFRKSTAS

SEQ ID NO: 10961 - protein, 71 aa, Anabaena variabilis ATCC 29413
MQIEETTIEEIQSKIKRLNSKAGQMKMDLHDLAEGLPTDYTQLMDVAAATYEIYRQLDELKQELKKLENTK

SEQ ID NO: 10962 - protein, 82 aa, Anabaena variabilis ATCC 29413
MVQSAKTDSVNQQTIEGLKLQIKKLNSKAGQLKMDLHDLAEGLPIDYQNLTALAAETYEIYRHLDELKSQLKSLEKNHDMGY

SEQ ID NO: 10963 - protein, 88 aa, Frankia CcI3
MTPDAQAADTPAADAQAADTPAGGAPADTELRLRKLRSRASQLKLDLHDLAEDLPIGWEGLLDAARRTYDAYAEIALLEGLLKKETSR

SEQ ID NO: 10964 - protein, 68 aa, Rhodopseudomonas palustris HaA2
MSDIDALKAELKKLSARATTMKMNLHDLSEELPINWQNIMTVAQQTHDAYAALEAARKALKELEAKAA

SEQ ID NO: 10965 - protein, 68 aa, Rhodopseudomonas palustris BisB18
MSDIETLKAEIKKLSSRAINAKMNLHDLSEELPVNWQTIMAVAQDTHDAYAALEAARKTLKELEAKAA

SEQ ID NO: 10966 - protein, 68 aa, Burkholderia xenovorans LB400
MSTDADELKARLKKLNAQATQAKMDLHDLSEELPTNWENILAVAQRCHDAHAALMAARAAAAAAAAAA

SEQ ID NO: 10967 - protein, 68 aa, Rhodopseudomonas palustris BisB5
MSDIDTLKAEIKKLSARATTMKMNLHDLSEELPINWQTIMTVAQQTHDAFAALEAARTTLKELEAKAA

SEQ ID NO: 10968 - protein, 66 aa, Polaromonas naphthalenivorans CJ2
MSTDADELKARLKKLNARATQAKMDLHDLSEDLPTNWEKILEVSQRCHEAHAALMEARKEAAAAAG

SEQ ID NO: 10969 - protein, 66 aa, Bradyrhizobium BTAi1
MSDLDTLKAEIKKLSARAMDAKMNLHDLSEELPINWDQILPTAQKAHEAFAELEKKRAELKKLETA

SEQ ID NO: 10970 - protein, 66 aa, Xanthobacter autotrophicus Py2
MSDVEELKAEIKKLSAKATQAKMDLHDLSEELPISWETIMDVAKRAHSAFAELEKKRADLKALEAA

SEQ ID NO: 10971 - protein, 87 aa, Frankia EAN1pec
MTPETSTSTSTDAGTDVAAVQTRLRKLNSKASQLKLDLHDLAEDLPINWENILDLARRTYDAYAEIALLENELRASAAGGTGKGAGA

SEQ ID NO: 10972 - protein, 66 aa, Leptothrix cholodnii SP 6
MADIDTLKAEIKKLNARATQSKMDLHDLSEDLPTNWEKILDVARTAHDAHAALMAARKQLADATPA

SEQ ID NO: 10973 - protein, 66 aa, Beijerinckia indica ATCC 9039
MSEVDELKAEIKKLSAKAMQAKMDLHDLSEELPINWQQILSVAQRAHEAFETLESKRAELNNSSAS

SEQ ID NO: 10974 - protein, 68 aa, Rhodopseudomonas palustris TIE 1
MSDIETLKAEIKKLSARATTMKMNLHDLSEELPINWQTIMTVAQETQDAYAALEAARKALKELEAKAA

SEQ ID NO: 10975 - protein, 87 aa, Acidithiobacillus ferrooxidans ATCC 53993
MSVLMEMLPIVEEQTNHWELIVDEKDALKTEIKRLNAQATQAKMDLHDLAEDLPVGWENILELANRTYAAYRDLTVARARLASFPGG

SEQ ID NO: 10976 - protein, 65 aa, Methylobacterium sp. 4-46
MSDIETLKAEIKKLSSRSVTAKMNLHDLSEDLPTNWQSILRVAQETYDAFQALDAARRALKAAEA

SEQ ID NO: 10977 - protein, 69 aa, Gluconacetobacter diazotrophicus PAl 5 JGI
MTDIAELKAELKKLSARATKAKMDLHDLSEDLPVNWQAIPDIAAQAHRAFAELTEKRAALAAIEDATKE

SEQ ID NO: 10978 - protein, 66 aa, Methylocella silvestris BL2
MSSIDEVKAEIRKLSSKAVNMKMALHDLSEDLPINWTTINDVAQQTYDAYKALEDARARLKALEDA

SEQ ID NO: 10979 - protein, 78 aa, Cyanothece PCC 7424
MVQLTSKTPTPEAVAELKTYIRRLNSKAGQMKMDLHDLAEGLPTDYQNLLEVATKTYDIFRELDQLNKQLKQWEEQLK

SEQ ID NO: 10980 - protein, 76 aa, Cyanothece PCC 8801
MVETTTSKPTAEEIDDLRKSIKRLNSVAGQMKMDLHDLAEGLPTDYENLLDTAQKTYDIFRQLDTLKKQLKTWEEL

SEQ ID NO: 10981 - protein, 87 aa, Acidithiobacillus ferrooxidans ATCC 23270; identical to SEQ ID NO: 10975

SEQ ID NO: 10982 - protein, 84 aa, Cyanothece PCC 7425
MAISPIVDATPAPTHCPSAEELRSQIKRLNSKAGQMKMDLHDLAEGLPTNYQQLMEVAAQTYAIFEQLDQLKQQLKVLEQKEKN

SEQ ID NO: 10983 - protein, 179 aa, Methylobacterium nodulans ORS 2060
MSDTETLKTEIKKLSARSATAKMNLHDSAEDLPTNWQSVPAVAQETHDAFAALDAARSEGRRGRGGLTLIGRNPAMAFTTRDGRAWIPDFLVAIDETTCIGCGRCYKVCSRDVMHLFGVGDGNLLLGKIEEDEDDDFDGELVRKVMVVDNAGACIGCGACARVCPKNCQTHVPADRIAA

SEQ ID NO: 10984 - protein, 76 aa, Cyanothece PCC 8802; identical to SEQ ID NO: 10980

SEQ ID NO: 10985 - protein, 151 aa, Brucella suis 1330
MELLDVIHTRAQAFEALKRIAARHGRPLNPDALVRLTHRADKKRRERCIELCEALIDLLAASFGASGAEIRSPLRGRQEVSRIRQIGMYVAHTSLGMAMNEVALGFARDRTTVMHACHTVEDLRDDVEFDALVSLFEKIVNSTFTAWRMAA

SEQ ID NO: 10986 - protein, 131 aa, Rhodopseudomonas palustris BisB18
MLDTPCAIAPSSAPPGQPPSPDQIVRRVVACVAADFGLSVSLLTGAPRGSPRIALARQIAMYLSHIGFGLSFEAIGRLFGRDRTTVAHACRVVEDSRDDVWMDGRLATLERICGTATPEPAASRRAAGARR

SEQ ID NO: 10987 - protein, 141 aa, Mesorhizobium BNC1
MQSIAASQLQEKQDKDAGVAARQDALGRKLSPICDERVNDICECVMDIVAALFNVSGKEIRSSGRSSTQVARVRQIGMYVAHVVLGLSMKEIGRGFGRDRTTVQHACHLIEDMRDDVEFDQIVLVIERVTAAAFRHTEVLG

SEQ ID NO: 10988 - protein, 128 aa, Maricaulis maris MCS10
MSRIMCRLEEDVARARLAQSAVAYAFGISQRELEAPTRRSREAALARQAAMYLAHVAFELPLTRVALAFGRDRTTAAHACHRIEDRRDDRAFDDYMDALEAALRTAPRLSGLQRLAGLERFERPERLT

SEQ ID NO: 10989 - protein, 151 aa, Brucella ovis
MELLDVIHMRAQAFEALKRIAARHGRPLNPDALVRLTHRADKKRRERCIELCEALIDLLAASFSASGAEIRSPLRGRQEVSRIRQIGMYVAHTSLGMAMNEVALGFARDRTTVMHACHTVEDLRDDVEFDALVSLFEKIVNSAFTAWRMAA

SEQ ID NO: 10990 - protein, 150 aa, Ochrobactrum anthropi ATCC 49188
MSLELSDVIHTRAEAFEALKLLAVRHGRSLNLGRVEGVADRSREQQNIALCDALIDLLVTMFGVSGAELRSPLRCRREVARVRQIGMYVAHTAFGLAMREVAAGFARDRTTVMHACHLVEDMRDDTEFDAIVSTFERIAQSAFTAWRLAA

SEQ ID NO: 10991 - protein, 136 aa, Parvibaculum lavamentivorans DS-1
MKERSFFVLWWERAMDWQNFAESGWVAGTINRVQAAQVALMQETVARAWNVPVDEIRSPTRRRAPVAQARQVAMYLTHVLYGFSLSAVGRHFGRDRTTAAHACRLVEDRRDDENFDMLLDRLEHALRRAGAAQALQ

SEQ ID NO: 10992 - protein, 130 aa, Xanthobacter autotrophicus Py2
MSYQPVEPHAACAQAPSRPSVAATPALSGTTGPTSCRLATAIVAAMAGLNVDALVDLRRSTAPVATARQIAMYLAHVGLGLSQAGVAQAFRRDRSTVAYACRRIEDLRDDPAFDHRVAQMEACLRWATER

SEQ ID NO: 10993 - protein, 128 aa, Caulobacter K31
MLAQVLEDLWAISPDPRRDKLAAAFITHAVALATGVAPADIASSKRTSKAAARARQIAIYLAHVNFNWPLIRVAFAFNRDRTTCGYACSRIEDMRENADFDARMTVLEACVKQAPETLPELTRIGVDR

SEQ ID NO: 10994 - protein, 121 aa, Agrobacterium vitis S4
MSAMPLEHPVPVKASSRVLCHSVARVTEEIFVVFQSPGLINAGRRRQRCHIRQIAMYLCHVVLSLPQQEIARAFGYDRSTVSHACHVIEDRRENAALDQFLGVLERVVAVLSTVAKDGRDA

SEQ ID NO: 10995 - protein, 73 aa, Enterobacter sp. 638
MGLNMEKITTFVAYWLAVGVAYFGAMSPEKLALYVGGGCAIFTALTNYWFKRKTYRYLISLGLDKGAIRELNH

SEQ ID NO: 10996 - protein, 71 aa, Escherichia coli HS
MTLERISAFITYCIAVVLAWLGDLSIKDASTLGGLMIGVLMLAINWYYKHKAYQLLRDGQISREDYESINR

SEQ ID NO: 10997 - protein, 72 aa, Serratia proteamaculans 568
MEKLTSTLAYLTAACLAWMGRHSTQDIALLVGAAVGVGTFAVNWYYRRKSYQLLKSLKKNGLKRGVYDELTR

SEQ ID NO: 10998 - protein, 71 aa, Escherichia coli C ATCC 8739
MTLERISAFITYCIAVVLAWLGDLSIKDASTLGGLMIGVLMLAINWYYKHKAYQLLRDGQISREDYESINH

SEQ ID NO: 10999 - protein, 69 aa, Salmonella enterica serovar Newport SL254
MDKITTFLTYWLSVVLAYFGTQTPERLALYVGGSCAIFTALVNFWYQRKKYRYLVSMGIDKGVIRGLIR

SEQ ID NO: 11000 - protein, 71 aa, Salmonella enterica serovar Agona SL483
MTLERISAFITYCIAVLLAWLGDLSLKDASTVGGVLIGVLMLAINWYYKHQSFKLLRGGKISRGEYESFNR

SEQ ID NO: 11001 - protein, 71 aa, Salmonella enterica serovar Dublin CT 02021853; identical to SEQ ID NO: 10996

SEQ ID NO: 11002 - protein, 69 aa, Pectobacterium carotovorum PC1
MERITSFIAYWISVALAFFGAMTPQDFAAYFGALGVVFTVGVNWYYRRKSYQLLKTIGNPREAIHEITR

SEQ ID NO: 11003 - protein, 110 aa, Nitrobacter winogradskyi Nb-255
MTRSVALALATGIGLAASLYTCASTTATAGPLSYELPRETIEFKPGPNLDVVKNNCLACHSADYIATQPRGPKFGKDFWQAEVNKMIGAYGAQIDEADIGKIVDYLAATY

SEQ ID NO: 11004 - protein, 110 aa, Nitrobacter hamburgensis X14
MMRPVLLALAVAIGLAGGIGAFAPTTAGAKPIAYKLPDKAAEFKPGPNLDVVKNNCTACHSADYVQTQPRGPKFTKDFWQAEVNKMIKVYGAQIEEADIGKIVDYLTATH

SEQ ID NO: 11005 - protein, 218 aa, Deinococcus geothermalis DSM 11300
MKYPLLMGMLFPVVALAVALPLSVLILPTPTVTGQTTAGQIAAPPSPASAATASPPSTSVTTPSVPRTQTASAVPATRPVPTTSAATTRPASAEFTPVQYAEQVRGVIDRITNGPYTTDSSYAIGSVPQDTPALADGENVDLVRATCSVCHATTFITSQPPLPAATWHDEVYKMKEKYGATFISDENADKIIAYLSAHYTPETRRAETPDAVRPAGQP

SEQ ID NO: 11006 - protein, 155 aa, Polaromonas naphthalenivorans CJ2
MKKSRPPLLPAAMLVFGFVCGAAMAQPASLKPLTIKLPPETARLKPSALPGYQAALQKCGICHSADYINLQSPAMTQPQWTAEVRKMQHAYAAPLTDKEVADIGEYLAVTYGGAKTSGMAVVVPPPVNTAAKAVDVQALLTANACLGCSISEITR

SEQ ID NO: 11007 - protein, 103 aa, Polynucleobacter necessarius asymbioticus QLW P1DMWA 1
MKKLILVSAAITISAFSQAKTIEMPADSVVWRKSDLPGYQLVIQKCTTCHSAHYAEYQPPNTGVGYWNTQVLRMKNVFKAPITDEEVPIIVQYLNQTYGANRK

SEQ ID NO: 11008 - protein, 116 aa, Acidiphilium cryptum JF-5
MKIISTYSARAALVALAAATVCGTIALAAAPGPTLGPLSVNVPSPGGYFQGTGAEILNQHCVTCHSAGFVERQPKLSASTWTVEVTKMKKAFGAPYAEADIPKIVDALVARQKAMK

SEQ ID NO: 11009 - protein, 112 aa, Sphingomonas wittichii RW1
MRDRTWLAAGLCALVAAIALSAGSRAAPRFAITSTSVELPYDETAYPEGPGAEVMNANCASCHSASMVLLQPRLSREQWTGIVRKMRDVYRAPVADEDVPAIIDYLAKLSPS

SEQ ID NO: 11010 - protein, 106 aa, Xanthobacter autotrophicus Py2
MIKHLKSLAAVAVAGTVAGPLASMVVAKPLTYELPEETSVFKPGPGIESAENNCAACHSADYITTQPPHMGRPFWEAEVHKMISAYHAPIDDTDAKAIVDYLAATY

SEQ ID NO: 11011 - protein, 111 aa, Xanthobacter autotrophicus Py2
MQHREETMRHKVKIVSVSFLAVALAGAALAAPKTYQLPDETATFRPGSGPGFEAAQNNCAACHSADYINYQPPKKGKAFWEAEVHKMIKVYKAPIEENDAKAIIEYLSNTY

SEQ ID NO: 11012 - protein, 105 aa, Methylobacterium radiotolerans JCM 2831
MRALVLGAVIAGLTAGAAWAAPRTYTLPDPTAQLRPPTDGGLTAGYEAAQANCQTCHSVDYIATQPPGRGKAFWDAEVAKMIKAYHAPIEQADAGAIAAYLARTY

SEQ ID NO: 11013 - protein, 112 aa, Methylobacterium radiotolerans JCM 2831
MNPIHPAALIAALALSPLVALAAPAPEPMRFTSQSIQMPTSDRIFPDGPGAEAVNNNCLACHSAGMVLTQPKLTKAQWTETVNKMVHVYKAPVDQADVQTIVDYLTALKPTP

SEQ ID NO: 11014 - protein, 144 aa, Burkholderia ambifaria MC40 6
MNARLKRMAVMLMVPVSVGALLGLVGRHYLPESIAAQAARQDAIAPPVHLSALNVTLPPGHSVFPPGPGADIANANCVMCHSTGMVLRQPPLTTSEWKVEITKMRNAFGAPISPDQIDALAHYLNAIDGRKPQAGPSGVDNQAS

SEQ ID NO: 11015 - protein, 92 aa, Sulfurihydrogenibium YO3AOP1
MKKFITIILTIFSISYAGEENLVLKEGKNKELAQAYCSACHSVDYIIMNSMFLDKKGWEAELDKMIKLGAPISKEDSKKIIDYLVKNYGINK

SEQ ID NO: 11016 - protein, 105 aa, Methylobacterium sp. 4-46
MPTIPRSALLALAALTIALGAARAAPRTYALPEGAAALRPGPEPGFSAAQANCLTCHSPDYLAMQPPGKGRAFWDAEVTKMIKVYRAPIDEADAKAIAAYLAAVY

SEQ ID NO: 11017 - protein, 106 aa, Methylobacterium chloromethanicum CM4
MNRITVALTATFALAAGAALAAPKSYDLPEPTATLRAPKASTHAGGFEAAQTNCLVCHSVDYIAMQPPGKGAAFWESEVHKMVKVYHAPIDEAQAKAIAAYLTATY

SEQ ID NO: 11018 - protein, 107 aa, Methylobacterium nodulans ORS 2060
MTKRFLTAAAAAGLLAGGAALAGPRTYALPEPTAQLKEPRDKAHAAGYEATQANCLTCHSVDYIAIQPPGKGRAFWDAEVTKMIKVYGAPISEADAKVIAAYLAAVY

SEQ ID NO: 11019 - protein, 110 aa, Methylobacterium nodulans ORS 2060
MTSLISRLALVSLAILGLSCAAAWIESARAKPMTYDLPEETSKLRPGAGVEVAEAHCLTCHSPDYIAMQPGGKGRAFWAAEISKMLKAYGAPISDDDAKTITDYLATTYP

SEQ ID NO: 11020 - protein, 107 aa, Methylobacterium nodulans ORS 2060
MTKRFLTAAAAAGLLAGGAALAGPRTYALPEPTAQLKEPRDKAHAAGYEATQANCLTCHSVDYIAIQPPGKGRAFWDAEVTKMIKVYGAPISEADAKTISEYLADRY

SEQ ID NO: 11021 - protein, 86 aa, Brucella suis 1330
MNAAPPRPPLEGLRKQLEKSRTRKNRMPRDGFVRETFTLPRQAARKKAREWFDTFPKAAYWTEIESWCERPDDVIEFTMRRLATAD

SEQ ID NO: 11022 - protein, 87 aa, Mesorhizobium BNC1
MRVPAKPPLEGLKRSLDKKRAKGEAKRLPRDGFVRETFALPRQEARAKAREWLERWPKQAYWTEIESWAERPGDVIEFTMRRLPSAD

SEQ ID NO: 11023 - protein, 86 aa, Brucella ovis; identical to SEQ ID NO: 11021

SEQ ID NO: 11024 - protein, 86 aa, Sinorhizobium medicae WSM419
MAKIPPGPPLEGLRRQIARHRRERPARSSGLFVRETFRLERDAARAKAREWFETWPKAAYWTEVESWRQLEGGEIEFTMRRLPSAD

SEQ ID NO: 11025 - protein, 90 aa, Ochrobactrum anthropi ATCC 49188
MTAAPPRPPLEGLRKQLQKSRAQKGLKQSRMPRDGFVRETFTLPRLAAREKAREWFETFPKAAYWTEIESWCERPDDVIEFTMRRLATAD

SEQ ID NO: 11026 - protein, 86 aa, Rhizobium leguminosarum bv  trifolii WSM2304
MKKVPGPPSFDGLKRRIARHRAETSSRRKDHFVRETYCLGLIDARAKAREWFDEYPKAAYWTEVESWRQLDGDQIEFTMRRLPSAD

SEQ ID NO: 11027 - protein, 92 aa, Agrobacterium vitis S4
MTGKRPLPPLDGLKRQIARHRDRQTKERGQAIRDASPFIRETFRLNREEARAKAREWFDAFPKAAYWTEVESWRQLEGDAIEFTMRRLSSAD

SEQ ID NO: 11028 - protein, 86 aa, Rhizobium leguminosarum bv  trifolii WSM1325
MKKVPGPPSFDGLKRRIARHRAENPPSKKDHFVRETYCLGLTDARAKAREWFDEYPKAAYWTEVESWRQLDGDQIEFTMRRLPSAD

SEQ ID NO: 11029 - protein, 97 aa, Syntrophomonas wolfei Goettingen
MIISKTQLLNVLKIYNKGDNKVEKAQAARGAARADELAISRESKVKQKAMHAVRQADDIRLEKVAELQEQISAGTYTLSDDEVAEKMIERVLVDRLI

SEQ ID NO: 11030 - protein, 97 aa, Clostridium thermocellum ATCC 27405
MKIWEGVPKVSGIYDSGKNVNKAEKTDGVTGKKDVVSISNQAKDFQTAMKALKEIPDIRKDKVEELARKIESGTYKVSEEDIADKILKSILDRKTQG

SEQ ID NO: 11031 - protein, 91 aa, Thermoanaerobacter sp. X514
MKIYNNNIEKIMSVYRVDAVEKVASKKAEIKDKVEISEEAIKLAQSSNEFEKIKNQKIENIKAMLSAGTYNVKAEDVADAILKGILLNKKI

SEQ ID NO: 11032 - protein, 109 aa, Natranaerobius thermophilus JW NM WN LF
MDKIRGDYNQYLRTYQKSISQLDKVQKIEKTGKGRGGEGAKKKDSLELTGLSKEIKVAREKISQLDSQEKARVNELKESIQSGTYDVSGDEIAGKIIETAREVQFDREV

SEQ ID NO: 11033 - protein, 88 aa, Halothermothrix orenii H 168
MRVNETQGQKISQLYIEKKKEVNKKNKMARKDKITISNKGIKVSEIKQELARIPDVRKRKIESLKRQIQEGNYRVPAREIARKLTENI

SEQ ID NO: 11034 - protein, 95 aa, Clostridium cellulolyticum H10
MKISGDVYNVSKVYNTQNHIGAVNQVNSVKSKKDVISISDNAKDHQLVFKALKEVPDIRQNKIDEFKEVYRSGTYNVSGQEIVEKLGKAVIDKKV

SEQ ID NO: 11035 - protein, 95 aa, Anaerocellum thermophilum DSM 6725
MRIEDRIRIFQIYTQTAKVTRVEKKQEPTATDKVEISSEARDFQAILNAIKQTPDVREDKVNEIKKKIDSGTYNVSGKDVVEKLIREYKDSKKNE

SEQ ID NO: 11036 - protein, 87 aa, Geobacillus WCH70
MKIHHIGPMNVNPYERQFNKVERQVPSTRKKDQVEISEAAKELQEASKWESARQEKVERLKQQVQNGTYTIDPQAIAKSIIHYYRKQ

SEQ ID NO: 11037 - protein, 114 aa, Rhodospirillum rubrum ATCC 11170
MDLISGENYHVRYDPTRSLVAISGILRLNGMSEYEPITAVLRQALAQNEILTIDLTELEFLNSSGIAMLSKFVIEARAHEGGSLTVLGSTAVAWQGKSLVNLKRLLPTLKLDFQ

SEQ ID NO: 11038 - protein, 117 aa, Sinorhizobium medicae WSM419
MGTEYMEIKEDEYRVWSEGNDIYFDGTMRLPSTEAYAPIFALVTSVLEAEPERMTVDLTGLQFLNSSGINLLAKLTIEARKRPNIQFTVRGSSEFPWQSKSLPNLKKLHPGVDLRLG

SEQ ID NO: 11039 - protein, 113 aa, Anaeromyxobacter sp. Fw109-5
MKPNKADYSVEAGPSPGTWLLRGVMRLESPEAYARAFEPLIASLGRGPAISIDLTQVAFLNSSGIRALADVLLQARDKRCQVKLFGSAAVPWQKKLASSLTALFPEIVMRVDR

SEQ ID NO: 11040 - protein, 112 aa, Rhizobium leguminosarum bv  trifolii WSM2304
MEISDENFRVWAEQNEVYFDGVFRLAGPDAYAPIYSLISGLLHDGHKQVTFNLTGLEFLNSSGINLLAKLTIEARKMGDLLLVVKGTHQYPWQAKSLPNLKKLHPLLDLRLA

SEQ ID NO: 11041 - protein, 114 aa, Cyanothece PCC 7424
MEIQSENYHISYNPATMIVNFRGSFRLNGMKDYEPIVNFLNEVAQQEPPTIILDLQKLEFLNSSGISMLSKFIINMRKKQTSNIVVKGSKNIPWQDKSLKNLQRLMPNLVLEFN

SEQ ID NO: 11042 - protein, 114 aa, Cyanothece PCC 8801
MEVQGENYQVTFDSDSATVTFAGSLRLGGMEEYQPIVEVLNHVSEQDYEAVILDVKKLEFLNSSGISMLSKFVINVRKKNTTSILVKGAKEFAWQEKSLKNLQRLMPNLNLEME

SEQ ID NO: 11043 - protein, 113 aa, Cyanothece PCC 7425
MEIRTKDYGIWYDPQQETVYCQGFLRLEGLDAYQPIINVLTEAIDQNNNLILDLQELEFLNSSGISMLSMFIVDIRNRGNVHLKVLGSKKVLWQSKSLKNLQRLMPAIDLEFI

SEQ ID NO: 11044 - protein, 114 aa, Thioalkalivibrio HL EbGR7
MHCFSGEGYKIELDDTSNTVRMSGALRLGGLSEYAPISELLENALDGREALIIDLSALEFLNSSGIATLSKFVITARNRNDCRLAIQGSNAIAWQGKSLNNLKRLMPALELNFD

SEQ ID NO: 11045 - protein, 112 aa, Rhizobium leguminosarum bv  trifolii WSM1325
MEISDENFRVWAEKNEVYFDGVFRLAGPDAYAPIYSLISGLLHEGHKQVTFNLTGLEFLNSSGINLLAKLTIEARKMGDLLLVVKGTSQYPWQAKSLPNLKKLHPLLDLRLA

SEQ ID NO: 11046 - protein, 114 aa, Cyanothece PCC 8802; identical to SEQ ID NO: 11042

SEQ ID NO: 11047 - protein, 88 aa, Shewanella sp. MR-7
MKKTIVLTIAGTDFSFHVTAQDHSDFIDAMARGGSVTAASYNFAMRTIDGDHKDDFKKLLESAPGAEVQIAGELKTEFAPVLEITVKK

SEQ ID NO: 11048 - protein, 102 aa, Marinomonas MWYL1
MPEIIITLGEGDDEKDIRFDVSMEDYNELLNNQVPGDKVGPGYNFLVSHVHQEDKATFKERVLVNGKTPNGMLVMLIVNEITNEVTGDVAVKLKKPKALPSK

SEQ ID NO: 11049 - protein, 88 aa, Yersinia pseudotuberculosis YPIII
MAEKNKIVLVVGGVELIFEPNTTAYNGFINDVGMENKIAPAFKYLRRIISKETKDALDEILKMPGAALQLIDKVNKVYAPELEIEVKN

SEQ ID NO: 11050 - protein, 85 aa, Salmonella enterica serovar Newport SL254
MEKIKLCVCGTDIIFEPNQTAYNKFINEMAMDNKVAPAHNYLTRIVATESKEALAEILKRPGAALQLVSKVNDIYAPELEIEVKN

SEQ ID NO: 11051 - protein, 85 aa, Salmonella enterica serovar Heidelberg SL476
MEKIKLCVCGTDIVFEPNQTAYNKFINEMAMDNKVAPAHNYLMRIVATESKEALAEILKRPGAALQLVSKVNDIYAPELEIEVKN

SEQ ID NO: 11052 - protein, 85 aa, Salmonella enterica serovar Agona SL483
MEKINLVVCKKEITFEPNQTAYNKFINEMAMDNKVAPAHSYLMRIVVPECKEALEDILKRPGAALQLAGKINELYAPELEIEVKN

SEQ ID NO: 11053 - protein, 87 aa, Aliivibrio salmonicida LFI1238
MTTPIIITAAGKDLRFTPDLPTYNKYINEMMPHDKVSPATNYLRRIVHKDDKAHLDEMLKIPSALMRILAKVNDAFEGDLEIEVKNS

SEQ ID NO: 11054 - protein, 130 aa, Rhodopseudomonas palustris HaA2; identical to SEQ ID NO: 10646

SEQ ID NO: 11055 - protein, 126 aa, Novosphingobium aromaticivorans DSM 12444; identical to SEQ ID NO: 10647

SEQ ID NO: 11056 - protein, 120 aa, Jannaschia CCS1; identical to SEQ ID NO: 10648

SEQ ID NO: 11057 - protein, 129 aa, Rhodopseudomonas palustris BisB18; identical to SEQ ID NO: 10649

SEQ ID NO: 11058 - protein, 130 aa, Rhodopseudomonas palustris BisB5; identical to SEQ ID NO: 10650

SEQ ID NO: 11059 - protein, 124 aa, Rhodobacter sphaeroides 2 4 1; identical to SEQ ID NO: 10652

SEQ ID NO: 11060 - protein, 116 aa, Paracoccus denitrificans PD1222; identical to SEQ ID NO: 10653

SEQ ID NO: 11061 - protein, 124 aa, Rhodobacter sphaeroides ATCC 17029; identical to SEQ ID NO: 10652

SEQ ID NO: 11062 - protein, 130 aa, Rhodopseudomonas palustris TIE 1; identical to SEQ ID NO: 10657

SEQ ID NO: 11063 - protein, 122 aa, Methylobacterium chloromethanicum CM4; identical to SEQ ID NO: 10658

SEQ ID NO: 11064 - protein, 118 aa, Frankia CcI3
MSRIFYLAFGAAAGVVVVRQVAKAAASLTPTSLAGSLVQSVQEFLADVREAAAEREEEIRVALGLDGDPDEADRGDAVGAAPPRDTAARVAGSGAPRYPADLDDAERTMRLVPGARRP

SEQ ID NO: 11065 - protein, 76 aa, Arthrobacter FB24
MKRILWMGIGVAIGVIAFRKITEAQSTLGPEGLNRAVGRLADGIYDFADAVRDGMQERESDLRAALGIDTQELVRR

SEQ ID NO: 11066 - protein, 86 aa, Acidothermus cellulolyticus 11B
MMKRVFYLAVGVGVGVVVARRVMRAADRLTPGGLADQARRSGAGVAAAIRGFIDDVRAAMAEREAELQEALTDEGPVSEDRWSPRK

SEQ ID NO: 11067 - protein, 105 aa, Nocardioides JS614
MRRGLWFVAGAGTAAYVLVRGRRAAEALTVDGLQDRLGALSVGMRLFRDEVAQGRAEKESELRERLGLVPHGRPELEGGRHRAVPSPTPTQTTTTTRTTTEEGST

SEQ ID NO: 11068 - protein, 101 aa, Salinispora tropica CNB-440
MRRLFWLGIGLAVGVLVVRKATRTAQAYTPAGIAGGLSESAGGLAESVRSFVSDVRIGMAEREQEIHEAFARGEAFDDNVADLREHPYTGDRETFPEEHQR

SEQ ID NO: 11069 - protein, 116 aa, Frankia EAN1pec
MGTRMFYVALGAATGVLVVRQVARAVSSLSPTGLAGSFVQSVREFAADVGEAMAEREEEIRSALGLDDADGSGDGERTGAATSTGAAASDQDTSAPGPDEFDPERTMRLVPGARRP

SEQ ID NO: 11070 - protein, 101 aa, Salinispora arenicola CNS-205
MRRLFWLGIGLAVGVLVVRKATRTAQAYTPAGIAGGLSESAGGLVESVRSFVSDVRIGMAEREQEIHEAFARGEAYDDHVADLREEPHTGDRENFPEEYQR

SEQ ID NO: 11071 - protein, 76 aa, Arthrobacter chlorophenolicus A6
MKRLVWMGIGVAIGVIAFRKVTEAQSALGPEGLNRAVGRLADGVYDFADAVRAGMQERETDLRSALGVETADLVRS

SEQ ID NO: 11072 - protein, 87 aa, Actinosynnema mirum DSM 43827
MSRLFWLGVGVAAGVLATRKANQAAHAATPAGIGANVGEGLRELATAIGSFGAEVRAGMVEREHELQETVERQTGHTPGRRARRAND

SEQ ID NO: 11073 - protein, 111 aa, Beutenbergia cavernae DSM 12333
MRRIFWIGVGAAAAVLVVRQLAQARAKADAAAEAFTPAGFADLVARGVDTLRDVGTEIAAAMREHEAELRADLLPPPDEVAAARARRASAPRPARGRDEDDGADAELYEFF

SEQ ID NO: 11074 - protein, 100 aa, Catenulispora acidiphila DSM 44928
MFTGTVRRLFWVSMGATAGVLVFRKVTATAKELTPAGLADRAAISGGGLLDSVKEFFEDVRERAHDREEELNVALGIDVPPTSTDRDPEGDGFSKKARAI

SEQ ID NO: 11075 - protein, 106 aa, Saccharomonospora viridis DSM 43017
MKRLFWLGVGVALGVTLSRKASETARQATPAGLASNLGDAVRELAGAIGAFGAEVRAGMTEREQELNDIVEQRSGLPRSGVARTERPRGGNAMPESRRGRARRAEI

SEQ ID NO: 11076 - protein, 118 aa, Jonesia denitrificans DSM 20603
MKRIVWLGIGVAVGVYAYSKVRQVARQYTPAGVSEKAEHLASDVVGRVETAVKGLAPDFSSAYAAREKELMDQLLADTQESVAEMRARRARHAARPSPGNDTDITDVDPDEEALGYSF

SEQ ID NO: 11077 - protein, 140 aa, Nakamurella multipartita DSM 44233
MKRVYVFGAGVALGVAATRRTRRAKEAAAAAMKAKLTPSAIAADLADAIAELGNAVGAFASDVRQGAINRRASYRPLVDNSTGAVVMVPPEALGPAPEPVEPRIPGGLPPTRPTPTRAHTVDPDPAGSSRSAARRVGHRA

SEQ ID NO: 11078 - protein, 152 aa, Ralstonia eutropha JMP134
MITDDIDVNCFPLRVVRVRRNGKRDCDPVAKRRLIELCLRPGASVAGMALKAQVNANQLRKWIRLDRESKAVEHGSLAAFVPVVQGVRSPEVEAVVTAPRRTTAVAVEPQPQPSRPVALLSAKLPNGVAIELACGERDGELVKAMIEALGAS

SEQ ID NO: 11079 - protein, 167 aa, Ralstonia eutropha JMP134
MRPQPLFADAIMMEAEFDVPPLRVIRIRSNGKRDFDRRDKRQLVEACLRPGVSVAGMALKVGINTNQLRKWIRLHQVASQATAAAESALPEFVPVVEVSGVTRVTESPMVQGCLPAQAPARTQPSQRPSLVPARLTARLPNGVTIELECGGQDVALVKAMIEALGER

SEQ ID NO: 11080 - protein, 164 aa, Burkholderia xenovorans LB400
MRTQMMTDTDFDFLPLRVTRTCADGKHRYDPEGKRKLIAACRRPGASLAGLALKAGVNANQLRKWVQLEERREVADVSHDAIAQAPSTFVPVVLIGESLASTPADTALPAPRPLLQRDPPRPSPRAAPLARLSATLPNGVVLELECSGRDTSLVTAMIAALGAG

SEQ ID NO: 11081 - protein, 155 aa, Burkholderia xenovorans LB400
MTQDDLSFLPLRVTRVGVGGKRSFDPLGKRRLVEACEQPGASLSGLALKAGVNANQLRKWVRLHRQAQTRMSNDGMAASPSAFVPVVAIADTAPAPASMHSVRMQPEQRSSHLSSRSPASAWLSAQLPNGVKLELECSERDAALVSAMIAALGRR

SEQ ID NO: 11082 - protein, 167 aa, Polaromonas JS666
MTTPAGTPSESAVTPAAPMLVLDRKSNGRAIYDPEAKRALVQQCLQPGVSVAATALRAGVNANLLRKWITKHQRGIGERASAPPSTIAGDRMPVVLRCDTAAAMTAAPAPGSLAGAPAPITIELHGARVHVASGVDPTTLAAGCGRCAPPHDRAPIGHAGVAGRRHH

SEQ ID NO: 11083 - protein, 170 aa, Nitrobacter hamburgensis X14
MHEVSTKIGGHLVMEDDDQKLRVRLVGRNGRRRYDPASKDRLVAACLEPGVSVSRLALEHGVNANLLRKWIKKRTETQSLPPSSSPAFIPVQIESTSDRALLRQSSMAAMDLPGACDGVRGSASKRAAPFSSPAKVSASLPNGVKLTLECGDVDALTAIIGALGHVQTGR

SEQ ID NO: 11084 - protein, 159 aa, Burkholderia cenocepacia HI2424
MTEQHSETSGLKVVSVGIDGKRRFDRHTKRRLVEACLEPGASVAGLALQHGVNANLLRKWIKLHQQRLSEDSTQSSTAESAFVPVVMVSSEQALVEHNSVRSSSLAATASSPANAAAASTLTAQMPNGITLKLECGKNDAALLSVMIETLGRCDVPAKR

SEQ ID NO: 11085 - protein, 155 aa, Sinorhizobium medicae WSM419
MMEEGQKLVVRLVGRNGRRRFDPASKDRLISACLEPGASVSKLALEHGVNANLVWKWIKKAKEVRALPPSSTSAFLPVQITAASSLPMHSSAFALEMPATDGEERRSQSERIDRLSSPAKVSASLPNGVKLSLECRDVDALTAVIGALGHVQTGR

SEQ ID NO: 11086 - protein, 152 aa, Xanthobacter autotrophicus Py2
MRCSTFRSSDLAAVPAAVLEKTVDAGETYVRRRRWSWAEKRAVVEEAAASGNVIGTAKRHGIQAQQIYRWRERFAERLDPPGFAAVSVVGDPPKALPAPMPDMDRPEERSSTVQTDARIEIVSAGGVAVRLPAGSPTDFVVAIASALSRGRR

SEQ ID NO: 11087 - protein, 154 aa, Burkholderia phymatum STM815
MTDDDLTFLPLRVTRVGVGGKRSFDPMGKQRLVDACLQPGASLSGLALKAGVNANQLRKWVQLREQSNAPVNEGMAVASSAFVPVVTIGEPAPSIALPPARRPFPEPEPSHQSPRAAPVARLSATLPNGVKLELECSGHDATLVTAMFAALGAR

SEQ ID NO: 11088 - protein, 159 aa, Burkholderia phytofirmans PsJN
MTEEHSETTGLKVVNVGRDGKRRYDRQTKQKLVEACLEPGASVAGLALKHGVNANLLRKWIKLHQQRLPRTSLQPAPTGTAFIPVAEVDSHEAVVAPASAKAHRHTPAARTSSPAMTSVRLMVQMPNGVTLRFECSGNDAPLLSAMIETLGRCDVPPGR
